(12) United States Patent
Daly

(10) Patent No.: US 7,544,854 B2
(45) Date of Patent: Jun. 9, 2009

(54) TRANSGENIC NON-HUMAN ANIMALS FOR PHARMACOLOGICAL AND TOXICOLOGICAL STUDIES

(75) Inventor: John Michael Daly, City Beach (AU)

(73) Assignee: Gene Stream Pty Limited, City Beach (AU)

( * ) Notice: Subject to any disclaimer, the term of this patent is extended or adjusted under 35 U.S.C. 154(b) by 125 days.

(21) Appl. No.: 10/475,069

(22) PCT Filed: Apr. 18, 2002

(86) PCT No.: PCT/AU02/00485

§ 371 (c)(1),
(2), (4) Date: Apr. 30, 2004

(87) PCT Pub. No.: WO02/083897

PCT Pub. Date: Oct. 24, 2002

(65) Prior Publication Data

US 2007/0101443 A1    May 3, 2007

(30) Foreign Application Priority Data

Apr. 18, 2001    (AU) .................................. PR4467

(51) Int. Cl.
*A01K 67/027* (2006.01)
*A01K 67/033* (2006.01)
*G01N 33/00* (2006.01)

(52) U.S. Cl. .................................. 800/18; 800/8; 800/3

(58) Field of Classification Search ...................... None
See application file for complete search history.

(56) References Cited

U.S. PATENT DOCUMENTS

| | | | |
|---|---|---|---|
| 4,994,384 A | 2/1991 | Prather et al. | |
| 5,057,420 A | 10/1991 | Massey | |
| 5,654,182 A | 8/1997 | Wahl et al. | |
| 5,677,177 A | 10/1997 | Wahl et al. | |
| 5,721,367 A | 2/1998 | Kay et al. | |
| 6,011,197 A | 1/2000 | Strelchenko et al. | |
| 6,020,143 A * | 2/2000 | St. George-Hyslop et al. | ... 435/7.1 |

FOREIGN PATENT DOCUMENTS

| | | |
|---|---|---|
| EP | 0 453 319 A | 10/1991 |
| EP | 1 206 906 A1 | 5/2002 |
| WO | WO 93/03164 A | 2/1993 |
| WO | WO 00/31237 A2 | 6/2000 |
| WO | WO 01/11951 A | 2/2001 |

OTHER PUBLICATIONS van Vlijmen, BJM, et al. J Biol Chem 271(48):30595-30602, 1996.*
Fuggar, L Curr Opin Immunol 12:698-703, 2000.*
Tomei, L et al. Hum Genet 84:89-91, 1989.*
Denning, C and H Priddle Reproduction 126:1-11, 2003.*

Gonzalez et al., (1999) "Role of gene knockout mice in understanding the mechanisms of chemical toxicity and carcinogenesis," *Cancer Lett.* 143:199-204.

Gonzalez, F.J., et al. (2001) "Understanding the role of xenobiotic-metabolism in chemical carcinogenesis using gene knockout mice," *Mutation Res.* 477:79-87.

Kemper, B. (1998) "Regulation of cytochrome P450 gene transcription by phenobarbital," *Prog Nucleic Acid Res. Mol. Biol.* 61:25-64.

Laub, R., et al. (2000) "A multiple transgenic mouse model with a partially humanized activation pathway for helper T cell responses," *J. Immunol. Methods* 246:37-50.

McKinnon, R.A., et al. (1998) "Cytochrome P450 knockout mice: new toxicological models," *Clin. Exp. Pharmacol. Physiol.* 25:783-787.

Mickisch, G.H., et al. (1991) "Multidrug resistant transgenic mice as a novel pharmacologic tool," *BioEssays* 13:381-387.

Simula, A.P., et al. (1993) "Heterologous expression of drug-metabolizing enzymes in cellular and whole animal models," *Toxicology* 82:3-20.

Van Dijk et al., (1991) "Effect of transgenic expression of human $\alpha_1$-acid glycoprotein (AGP) on the glycosylation of human and mouse AGP in various transgenic mouse sera," *Eur. J. Cell Biol.* 55:153-148.

Wolf, C.R., et al., (1998) "Use of transgenic animals in understanding molecular mechanisms of toxicity," *J. Pharm. Pharmacol.* 50:567-574.

Bradley, M. O. et al. (1984) "Formation of germ-line chimaeras from embryo-derived teratocarcinoma cell lines" *Nature* 309:255-258.

Robertson, et al. (1986) "Germ-line transmission of genes introduced into cultured pluripotential cells by retroviral vector" *Nature* 322:445-448.

Schinke et al. (1999) "Blood pressure reduction and diabetes insipidus in transgenic rats deficient in brain angiotensinogen" *PNAS USA* 96:3975-80.

Supplementary European Search Report from corresponding European Patent Application No. EP 02 71 7850.

Suraokar et al. (2000) "Targeting sheep" *Nature* 405:1004-1005.

* cited by examiner

*Primary Examiner*—Deborah Crouch
*Assistant Examiner*—Marcia S Noble
(74) *Attorney, Agent, or Firm*—Knobbe Martens Olson & Bear LLP

(57) ABSTRACT

The present invention is directed to the production, breeding and use of transgenic non-human animals such as mice in which specific genes or portions of genes have been replaced by homologues from another animal to make the physiology of the animals so modified more like that of the other animal with respect to drug pharmacokinetics and metabolism. The invention also extends to the use of the genetically modified non-human animals of the invention for pharmacological and/or toxicological studies.

30 Claims, 4 Drawing Sheets

TRANSGENIC NON-HUMAN ANIMALS FOR PHARMACOLOGICAL AND TOXICOLOGICAL STUDIES

Related Applications

This Application is a National Phase under 35 U.S.C. 371 of International Application No. PCT/AU02/00485 filed Apr. 18, 2002 and published in English as WO 02/083897, which claims the benefit of priority of Australian Application PR4467/01 filed Apr. 18, 2001, both of which are expressly incorporated herein in their entireties.

FIELD OF THE INVENTION

THIS INVENTION relates generally to non-human animals into which foreign nucleic acid has been introduced to produce transgenic animals. More specifically, the invention relates to the production, breeding and use of transgenic non-human animals such as mice in which specific genes or portions of genes have been replaced by homologues from another animal to make the physiology of the animals so modified more like that of the other animal with respect to drug pharmacokinetics and metabolism. The invention also extends to the use of the genetically modified non-human animals of the invention for pharmacological and/or toxicological studies.

BACKGROUND OF THE INVENTION

The cost of bringing a new drug to the market is extremely high. Typically, a pharmaceutical company will screen hundreds to hundreds of thousands of compounds, in order to choose a single drug for marketing. Initial screening is performed in vitro with the most promising compounds progressing to animal studies. It is on the basis of these animal studies that the best drug(s) is chosen for further development and clinical trials. Since a considerable amount of the cost associated with drug development occurs subsequent to the animal studies, the accuracy of the animal model at predicting a drug's behaviour in humans, is of obvious importance.

During drug discovery and development, animal models are used in an iterative process of characterising the drug candidates. Initial animal studies determine the pharmacokinetics (the kinetics of drug absorption, distribution throughout the body and its eventual elimination from the body). Subsequent animal studies measure pharmacodynamics (mechanisms of drug action, and the relationship between drug concentration and effect). Typically, these studies also look at efficacy (e.g. does the compound block tumour growth, or is the compound effective in combating neurological disorders), short-term toxicity, optimal dosing and scheduling etc. Based on these animal studies, the most promising compound(s) is further developed. This stage involves continued animal studies (e.g. longer term toxicity studies, exhaustive metabolic studies, multiple-administration pharmacokinetic studies, expanded efficacy studies often including drug combination studies), chemical development (e.g. production) and pharmaceutical development (e.g. drug formulation and delivery). Compounds that successfully complete all of these stages are then tested in human patients (Phase I-III clinical trials). A successful Phase I trial would demonstrate good tolerability, suitable pharmacokinetics, and in some cases demonstrate the intended pharmacodynamic properties in humans. Such a drug would progress to Phase II and Phase III clinical trials for testing of the optimal dosing regime as well as efficacy in the treatment of disease.

The development of a single drug often requires the testing of many different compounds in mice or other animal species. These animal studies determine the choice of compound for further development and clinical trials. The main reasons for drug failure at the clinical trial stage are inappropriate pharmacokinetics and toxicological effects (often both are related to drug metabolism), and to a lesser extent, lack of efficacy due to failed concept or lack of pharmacodynamic effect. That compounds progress to clinical trials and then fail at this late stage is usually due to the poor predictability of existing animal models.

An incorrect decision, based on data from an animal model that did not accurately reflect drug behaviour in humans, can waste vital resources, many millions of dollars and years of labour. Moreover, the opportunities lost by not pursuing other candidate compounds could potentially cost billions in lost revenue. For example, current mouse models often (and unpredictably) do not accurately reflect human drug pharmacokinetics, metabolism and toxicology. Many drugs show promising results in mice but fail to work effectively in humans. Similarly, other drugs, which failed in mice and consequently were rejected, may have worked well in humans. Thus, the process of selecting candidate drugs for further development and clinical trials is currently based on data obtained from a flawed animal model. The consequences of this include; a) wastage of valuable resources pursuing drugs that will not work in humans; b) lost opportunities by not pursuing drugs which would work in humans and c) exposure of patients to unknown risks in Phase 1 clinical trials.

An improved animal model, which more accurately predicts the behaviour (e.g. distribution, metabolism, efficacy and toxicity) of drugs in the animals of interest (e.g. humans and other mammals including livestock animals and companion animals) would provide enormous benefit to both the pharmaceutical and/or veterinary industries and to the treatment of diseases affecting those animals.

SUMMARY OF THE INVENTION

Accordingly, in one aspect of the present invention, there is provided the use of a transgenic non-primate mammal for predicting the likely behaviour of a drug in a selected species of primate, as part of a drug screening or evaluation process, the transgenic mammal expressing at least a portion of a foreign polypeptide that is associated with drug behaviour and/or metabolism, and that is expressed naturally in the selected species of primate or in a primate of a different species, or that otherwise corresponds to the naturally expressed polypeptide, wherein the expression of an endogenous homologue of the foreign polypeptide in the transgenic mammal is abrogated or otherwise reduced, and wherein the foreign polypeptide is other than the intended target of the drug. The foreign polypeptide is suitably selected from a drug-binding polypeptide, a drug-metabolising polypeptide, a drug-binding and drug-metabolising polypeptide or a drug-transporting polypeptide.

Suitably, the transgenic mammal lacks the ability to produce a functional endogenous polypeptide or detectable levels of the endogenous polypeptide. The foreign polypeptide is preferably a functional homologue of the endogenous polypeptide. In one embodiment of this type, the foreign polypeptide is an orthologue of the endogenous polypeptide. In another embodiment of this type, the foreign polypeptide is a paralogue of the endogenous polypeptide.

The transgenic mammal may comprise an alteration to its genome, wherein the alteration comprises replacement of the endogenous gene encoding the endogenous polypeptide with a transgene comprising a nucleotide sequence encoding the foreign polypeptide. Alternatively, the alteration may comprise a disruption in said endogenous gene. Suitably, the disruption results in reduced expression levels of the endogenous polypeptide. In a preferred embodiment, the disruption results in abrogated expression levels of the endogenous polypeptide. In another preferred embodiment, the mammal lacks the ability to produce a functional endogenous polypeptide. In another embodiment, the disruption comprises a deletion of at least a portion of the endogenous gene. Suitably said deletion comprises a deletion of nucleotide sequences encoding a region or domain of the endogenous polypeptide. Alternatively, the deletion comprises a deletion of a regulatory polynucleotide that controls at least in part the expression of the endogenous gene. In a preferred embodiment, the deletion comprises a deletion of the entire open reading frame encoding the endogenous polypeptide.

Suitably, the nucleotide sequence, encoding the foreign polypeptide, is operably linked to a regulatory polynucleotide. The regulatory polynucleotide may comprise a nucleotide sequence of 1-10 kb. The regulatory polynucleotide is preferably a polynucleotide that is naturally present in the transgenic mammal or in the selected species of primate. In one embodiment, the regulatory polynucleotide is an endogenous polynucleotide of the transgenic mammal, or ancestor thereof. In another embodiment, the regulatory polynucleotide is an endogenous polynucleotide of the selected species of primate. In a preferred embodiment, the regulatory polynucleotide comprises a nucleotide sequence that is naturally located upstream of the coding sequence of the endogenous gene. In another preferred embodiment, the regulatory polynucleotide comprises a nucleotide sequence that is naturally located upstream of the coding sequence of a gene encoding the foreign polypeptide. In an alternative embodiment, the regulatory polynucleotide is derived from an animal or source other than an animal selected from said transgenic mammal, an ancestor of the transgenic mammal or the selected species of primate. In another embodiment, the regulatory polynucleotide comprises an inducible promoter (e.g. metallothionein promoter).

Suitably, the alteration has been introduced into the genome of the transgenic mammal by homologous recombination, random integration or the use of a recombinase system (e.g. Cre-loxP or FLP-FRT system) with a nucleic acid construct, comprising the transgene, in an embryonic stem cell such that the construct is stably integrated in the genome of the mammal.

The transgenic animal may be heterozygous, but is preferably homozygous, for the transgene.

In one embodiment, the transgenic animal is selected from the order Rodentia. In a particularly preferred embodiment, the transgenic animal is a mouse.

In a preferred embodiment, the selected species of primate is human.

The foreign polypeptide may be selected from a serum albumin, an α-acidic glycoprotein (AGP), a cytochrome p450 (CYP), a uridine diphosphoglucuronosyl transferase (UGT), a multidrug-resistance (MDR) protein including multidrug-resistance-associated proteins (MRPs), an acetyl-transferase, a prenyl protein transferase, a peptidase, an esterase, an acetylase, a glucuronidase, a glutathione S-transferase, or a polypeptide that facilitates or catalyses a reaction selected from an oxidative reaction, a conjugation reaction, a hydrolytic reaction, a reductive metabolism or other catabolic or anabolic reaction involving a xenobiotic. In one embodiment, the foreign polypeptide is serum albumin, which is preferably but not exclusively human serum albumin. The human serum albumin preferably comprises the sequence set forth in SEQ ID NO: 2. In a preferred embodiment, the nucleotide sequence encoding the human serum albumin comprises the sequence set forth in any one of SEQ ID NO: 1 and 3. In another preferred embodiment, the expression of endogenous serum albumin is altered. Suitably, the endogenous serum albumin is a mouse serum albumin comprising the sequence set forth in SEQ ID NO: 6. Preferably, the endogenous gene for mouse serum albumin encodes a transcript comprising the sequence set forth in SEQ ID NO: 5. The regulatory polynucleotide suitably comprises a nucleotide sequence that is naturally located upstream of the coding sequence relating to the endogenous gene. Preferably, the regulatory polynucleotide comprises the sequence as set forth in SEQ ID NO: 7.

In another embodiment, the foreign polypeptide is an alpha acidic glycoprotein (AGP). In a preferred embodiment of this type, the foreign polypeptide is a human AGP selected from AGP-1, AGP-2 and AGP-3. Suitably, the human AGP-1 (also known as orosomucoid (ORM)-1) comprises the sequence set forth in SEQ ID NO: 14. Preferably, the nucleotide sequence encoding the human AGP-1 comprises the sequence set forth in SEQ ID NO: 13. Suitably, the human AGP-2 (also known as ORM-2) comprises the sequence set forth in SEQ ID NO: 16. Preferably, the nucleotide sequence encoding the human AGP-2 comprises the sequence set forth in SEQ ID NO: 15. In another preferred embodiment, the expression of an endogenous AGP is altered. Suitably, the endogenous AGP is a mouse selected from AGP-1, AGP-2 and AGP-3. Suitably, the mouse AGP-1 comprises the sequence set forth in SEQ ID NO: 10. Preferably, the endogenous gene encoding the mouse AGP-1 comprises the sequence set forth in SEQ ID NO: 9. Suitably, the mouse AGP-3 comprises the sequence set forth in SEQ ID NO: 12. Preferably, the endogenous gene encoding the mouse AGP-3 comprises the sequence set forth in SEQ ID NO: 11. The regulatory polynucleotide, in this instance, suitably comprises a nucleotide sequence that is naturally located upstream of the coding sequence relating to the gene encoding the foreign polypeptide. Preferably, the regulatory polynucleotide comprises the sequence set forth in SEQ ID NO: 21 and/or 22, which correspond to regulatory polynucleotides located naturally upstream of the human AGP-1 and AGP-2 genes, respectively.

In another aspect, the invention contemplates a transgenic non-primate mammal, or progeny thereof, for predicting the likely behaviour of a drug in a selected species of primate, the transgenic animal expressing at least a portion of a foreign drug-binding polypeptide that is expressed naturally in the selected species of primate or in a primate of a different species, or that otherwise corresponds to the naturally expressed polypeptide, wherein the expression of an endogenous homologue of the foreign polypeptide in the transgenic mammal is abrogated or otherwise reduced.

In yet another aspect, the invention encompasses a transgenic non-primate mammal, or progeny thereof, for predicting the likely behaviour of a drug in a selected species of primate, the transgenic animal expressing at least a portion of a foreign drug-binding polypeptide selected from the group consisting of a serum albumin and an alpha acidic glycoprotein, wherein the drug-binding polypeptide is expressed naturally in the selected species of primate or in a primate of a different species, or that otherwise corresponds to the naturally expressed polypeptide, wherein the expression of an endogenous homologue of the foreign polypeptide in the transgenic mammal is abrogated or otherwise reduced.

Preferably, the transgenic mammal further expresses at least a portion of at least one other foreign polypeptide that is associated with drug behaviour and/or metabolism and that is expressed naturally in the selected species of primate or in a primate of a different species, or that otherwise corresponds to the naturally expressed polypeptide, wherein the expression of a respective endogenous homologue of the corresponding other foreign polypeptide in the transgenic mammal is abrogated or otherwise reduced. Suitably, the or each other foreign polypeptide is selected from a drug-binding polypeptide, a drug-metabolising polypeptide, a drug-binding and a drug-metabolising polypeptide or a drug-transporting polypeptide. In a preferred embodiment of this type, the or each other foreign polypeptide is selected from the group consisting of a serum albumin, an alpha acidic glycoprotein, a cytochrome p450 (CYP), which a preferably selected from selected from subfamily 3A, a uridine diphospho-glucuronosyl transferase (UGT) selected from subfamily 1A, a uridine diphospho-glucuronosyl transferase, and a multidrug-resistance protein. (MDR), including P-glycoprotein and multi-drug-resistance-associated proteins (MRPs).

In yet another aspect, the invention encompasses a nucleic acid construct, which is preferably but not exclusively a targeting construct, for use in producing a transgenic non-primate mammal for predicting the likely behaviour of a drug in a selected species of primate, the construct including a transgene comprising a nucleotide sequence encoding at least a portion of a foreign polypeptide that is associated with drug behaviour and/or metabolism, and that is expressed naturally in the selected species of primate or in a primate of a different species or that otherwise corresponds to the naturally expressed polypeptide. In one embodiment, the nucleic acid construct is a targeting construct comprising two regions flanking the transgene wherein the regions are sufficiently homologous with portions of the genome of the non-primate mammal to undergo homologous recombination with the portions. In a preferred embodiment of this type, the portions comprise a sequence flanking, or contained by, the endogenous gene that encodes a polypeptide of the non-primate mammal, which polypeptide is a homologue of the foreign polypeptide. The transgene preferably comprises a regulatory polynucleotide operably linked to the sequence encoding at least a portion of the foreign polypeptide. Suitably, the nucleic acid construct comprises a selectable marker gene.

In a further aspect, the invention resides in a method of producing a transgenic non-primate mammal for predicting the likely behaviour of a drug in a selected species of primate, the method comprising:
  providing a transgene comprising a nucleotide sequence encoding at least a portion of a foreign polypeptide that is associated with drug behaviour and/or metabolism, and that is expressed naturally in the selected species of primate or in a primate of a different species or that otherwise corresponds to the naturally expressed polypeptide; and
  introducing the transgene into the genome of a non-primate mammal.

Preferably, the introduction of the transgene into the genome includes producing a nucleic acid construct as broadly described above.

Suitably, the introduction of the transgene into the genome includes functionally disrupting the endogenous gene, which is preferably achieved by disrupting the structure of the endogenous gene. Alternatively, the introduction of the transgene into the genome may include inserting the transgene at a site other than that of said endogenous gene. In one embodiment, the introduction of the transgene into the genome includes replacing the endogenous gene or portion thereof with the transgene. In a preferred embodiment, the function of the endogenous gene is disrupted using, for example, a suitable targeting construct.

The method preferably further includes the step of introducing a selectable marker gene into the genome of the non-primate mammal. In a preferred embodiment of this type, the selectable marker gene is incorporated into a targeting construct, as for example, described above.

In yet a further aspect, the invention resides in a method of producing a transgenic non-primate mammal for predicting the likely behaviour of a drug in a selected species of primate, the method comprising:
  providing a targeting construct including a transgene comprising a nucleotide sequence encoding at least a portion of a foreign polypeptide that is associated with drug behaviour and/or metabolism, and that is expressed naturally in the selected species of primate or in a primate of a different species or that otherwise corresponds to the naturally expressed polypeptide, and regions flanking the transgene wherein the regions are sufficiently homologous with portions of the genome of the non-primate mammal to undergo homologous recombination with the portions; and
  introducing the targeting construct into the genome of a non-primate cell under conditions sufficient for the transgene to homologously recombine into a region of the genome interposed between the portions.

According to another aspect, the invention provides a method of producing a transgenic non-primate mammal for predicting the likely behaviour of a drug in a selected species of primate, the method comprising:
  providing a nucleic acid construct including a transgene comprising a nucleotide sequence encoding at least a portion of a foreign polypeptide that is associated with drug behaviour and/or metabolism, and that is expressed naturally in the selected species of primate or in a primate of a different species or that otherwise corresponds to the naturally expressed polypeptide; and
  introducing the construct into the genome of a non-primate cell under conditions such that the transgene is randomly integrated into the genome.

In yet a further aspect, the invention resides in a method of producing a transgenic non-primate mammal for predicting the likely behaviour of a drug in a selected species of primate, the method comprising:
  providing a targeting construct including a transgene comprising a nucleotide sequence encoding at least a portion of a foreign polypeptide that is associated with drug behaviour and/or metabolism and that is expressed naturally in the selected species of primate or in a primate of a different species or that otherwise corresponds to the naturally expressed polypeptide, and regions flanking the transgene wherein the regions are sufficiently homologous with portions of the genome of the non-primate mammal to undergo homologous recombination with the portions, wherein the portions flank, or are contained within, the endogenous gene encoding at least a portion of a polypeptide of the non-primate mammal, which polypeptide is a homologue of the foreign polypeptide; and
  introducing the targeting construct into the genome of a non-primate cell under conditions sufficient for the transgene to homologously recombine into at least one of the alleles of the endogenous gene in the genome of the cell to thereby produce a cell containing at least one allele of the endogenous gene replaced, or disrupted, with the transgene.

The present invention further resides in a method of producing a transgenic non-primate mammal for predicting the likely behaviour of a drug in a selected species of primate, the method comprising:
  providing a first targeting construct including a transgene comprising a nucleotide sequence encoding at least a portion of a foreign polypeptide that is associated with drug behaviour and/or metabolism and that is expressed naturally in the selected species of primate or in a primate of a different species or that otherwise corresponds to the naturally expressed polypeptide, wherein the transgene is flanked by portions of the genome of a non-primate cell; and providing a second targeting construct comprising: i) at least a portion of the endogenous gene encoding an endogenous polypeptide that is a homologue of the foreign polypeptide; and ii) a polynucleotide capable of disrupting the endogenous gene;

introducing the first targeting construct into the non-primate cell under conditions sufficient for the transgene to homologously recombine into a region of the genome of the cell, corresponding to the portions; and introducing the second targeting construct into the cell under conditions sufficient for the polynucleotide to homologously recombine into at least one allele of the endogenous gene in the genome of the cell to thereby produce a cell containing at least one disrupted allele of the endogenous gene.

The present invention further extends to a method of producing a transgenic non-primate mammal for predicting the likely behaviour of a drug in a selected species of primate, the method comprising:

providing a nucleic acid construct including a transgene comprising a nucleotide sequence encoding at least a portion of a foreign polypeptide that is associated with drug behaviour and/or metabolism and that is expressed naturally in the selected species of primate or in a primate of a different species or that otherwise corresponds to the naturally expressed polypeptide;

providing a targeting construct comprising: i) at least a portion of the endogenous gene encoding an endogenous polypeptide that is a homologue of the foreign polypeptide; and ii) a polynucleotide capable of disrupting the endogenous gene;

introducing the nucleic acid construct into a non-primate cell under conditions sufficient for the transgene to randomly integrate into a region of the genome of the cell; and introducing the targeting construct into the cell under conditions sufficient for the polynucleotide to homologously recombine into at least one allele of the endogenous gene in the genome of the cell to thereby produce a cell containing at least one disrupted allele of the endogenous gene.

The cell employed in the above production method is preferably an embryonic stem cell, preferably an embryonic stem cell from a mammal within the order Rodentia and most preferably a mouse embryonic stem cell.

In a preferred embodiment, the method further comprises injecting the embryonic stem cell containing at least one transgene into the blastocyst or other early developmental stage of a non-human animal.

In another preferred embodiment, the method further comprises introducing the injected blastocyst into a pseudo-pregnant non-human animal and permitting the pseudo-pregnant animal to deliver progeny containing at least one homologously recombined transgene.

In yet another preferred embodiment, the progeny containing the at least one homologously recombined transgene is further characterised by expressing at least a portion of the foreign polypeptide at detectable levels.

In another preferred embodiment, the progeny containing the at least one homologously recombined transgene is further characterised by expressing reduced or undetectable levels of the endogenous polypeptide.

In an alternative preferred embodiment, the progeny lacks the ability to produce functional endogenous polypeptide.

The method may further include the step of breeding a transgenic non-primate mammal produced by a method as broadly described above and producing progeny of that mammal. For example, mammals containing the same transgene can be inbred to produce mammals that are homozygous for the transgene. Alternatively or additionally, transgenic mammals containing different transgenes described in this invention can be interbred to produce mammals containing two or more different transgenes. Alternatively or additionally, any of these transgenic mammals can be crossbred with any other genetically modified, wild-type or mutant mammals of the same species in order to obtain mammals containing the transgene(s) described in the present invention as well as the desired genetic characteristics of the other mammals used in the crossbreeding strategy. When the transgenic mammal is a mouse, crossbreeding strategies may include crossbreeding the transgenic mouse with another mouse including, but not restricted to, a nude mouse, a SCID mouse, an inbred strain of mouse such as BALB/c, a mouse designed to mimic a specific human disease or a mouse with a useful reporter construct.

The transgenic mammals and cells derived therefrom are useful for screening biologically active agents including drugs and for investigating their distribution, efficacy, metabolism and/or toxicity. These screening methods are of particular use for assessing with improved predictability the behaviour of a drug in the primate species of interest. Accordingly, in yet a further aspect, the invention features a method of assessing the behaviour of a drug in a selected species of primate, as part of a drug screening or evaluation process, comprising administering a drug to a transgenic non-primate mammal expressing at least a portion of a foreign polypeptide that is associated with drug behaviour and/or metabolism, and that is expressed naturally in the selected species of primate or in a primate of a different species or that otherwise corresponds to the naturally expressed polypeptide, and wherein the foreign polypeptide is other than the intended target of the drug, and conducting analytical tests to determine the behaviour of the drug in the transgenic mammal, the results of which have a higher correlation to the behaviour of the drug in the selected species of primate than the results obtained from a mammal of the same species as the transgenic mammal, which expresses the endogenous polypeptide but which does not express the foreign polypeptide or portion thereof.

In one embodiment, the analytical test comprises assessing directly or indirectly, the concentration and/or distribution of the drug in the transgenic mammal to which it has been administered. In another embodiment, the analytical test comprises assessing directly or indirectly, the efficacy of the drug in the transgenic mammal to which it has been

Figure 1:
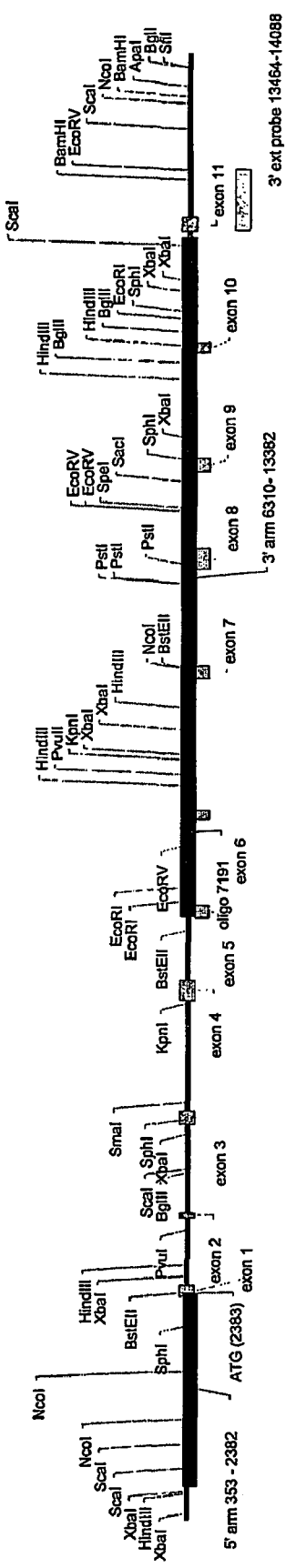
FIG. 1 is a schematic representation showing a linear map of the mouse ALB gene.

BRIEF DESCRIPTION OF THE SEQUENCES:
SUMMARY TABLE

TABLE A

| SEQUENCE ID | DESCRIPTION | LENGTH |
|---|---|---|
| SEQ ID NO: 1 | Nucleotide sequence corresponding to the human serum albumin gene as set forth in GenBank Accession No. M12523 | 19002 nts |
| SEQ ID NO: 2 | Polypeptide encoded by SEQ ID NO: 1 | 609 aa |
| SEQ ID NO: 3 | Nucleotide sequence corresponding to the human serum albumin mRNA as set forth in GenBank Accession No. XM_031320 | 2216 nts |
| SEQ ID NO: 4 | Polypeptide encoded by SEQ ID NO: 3 | 609 aa |
| SEQ ID NO: 5 | Nucleotide sequence corresponding to mouse serum albumin (ALB) mRNA as set forth in GenBank Accession No. AJ011413 | 2027 nts |
| SEQ ID NO: 6 | Polypeptide encoded by SEQ ID NO: 5 | 608 aa |
| SEQ ID NO: 7 | Nucleotide sequence corresponding to the flanking sequence immediately upstream of the coding sequence of the mouse ALB gene, as set forth in GenBank Accession No. J04738 | 2079 nts |
| SEQ ID NO: 8 | Nucleotide sequence corresponding to a flanking sequence upstream of the alpha fetoprotein (AFP) gene, as set forth in GenBank Accession No. J05246 | 900 nts |
| SEQ ID NO: 9 | Nucleotide sequence corresponding to the mouse alpha-1-acid glycoprotein I (AGP-1) gene, as set forth in GenBank Accession No. M17376 | 4133 nts |
| SEQ ID NO: 10 | Polypeptide encoded by SEQ ID NO: 9 | 207 aa |
| SEQ ID NO: 11 | Nucleotide sequence corresponding to the mouse alpha-1-acid glycoprotein 3 (AGP-3) gene, as set forth in GenBank Accession No. S38219 | 4002 aa |
| SEQ ID NO: 12 | Polypeptide encoded by SEQ ID NO: 11 | 206 aa |
| SEQ ID NO: 13 | Nucleotide sequence corresponding to the coding sequence of human orosomucoid 1 (ORM-1) gene, as set forth in GenBank Accession No. NM_000607 | 803 nts |
| SEQ ID NO: 14 | Polypeptide encoded by SEQ ID NO: 13 | 201 aa |
| SEQ ID NO: 15 | Nucleotide sequence corresponding to the coding sequence of the human orosomucoid 2 (ORM-2) gene, as set forth in GenBank Accession No. NM_000608 | 606 nts |
| SEQ ID NO: 16 | Polypeptide encoded by SEQ ID NO: 15 | 201 aa |
| SEQ ID NO: 17 | Nucleotide sequence corresponding to the human orosomucoid 2 (ORM-2) gene, as set forth in GenBank Accession No. M21540 | 4944 nts |
| SEQ ID NO: 18 | Polypeptide encoded by SEQ ID NO: 17 | 201 aa |
| SEQ ID NO: 19 | Nucleotide sequence corresponding to the human DNA sequence from BAC clone RP11-82I1 relating to chromosome 9, as set forth in GenBank Accession No. AL356796 | 125673 nts |
| SEQ ID NO: 20 | Nucleotide sequence corresponding to human AGP-1-AGP-2 transgene | 18875 nts |
| SEQ ID NO: 21 | Nucleotide sequence corresponding to human AGP-1 promoter | 6032 nts |
| SEQ ID NO: 22 | Nucleotide sequence corresponding to human AGP-2 promoter | 1944 nts |
| SEQ ID NO: 23 | Nucleotide sequence corresponding to human DNA sequence from BAC clone RP11-757A13, as set forth in GenBank Accession No. AC069294 | 123778 nts |
| SEQ ID NO: 24 | Nucleotide sequence corresponding to human cytochrome P450, subfamily IIIA (niphedipine oxidase), polypeptide 4 (CYP3A4), mRNA, as set forth in GenBank Accession No. NM_017460 | 2764 nts |
| SEQ ID NO: 25 | Polypeptide encoded by SEQ ID NO: 24 | 503 aa |
| SEQ ID NO: 26 | HALB1F primer | 24 nts |
| SEQ ID NO: 27 | HALB3R primer | 27 nts |
| SEQ ID NO: 28 | HALB5F primer | 30 nts |
| SEQ ID NO: 29 | HALB4R primer | 20 nts |
| SEQ ID NO: 30 | Forward primer corresponding to nt 1-32 of SEQ ID NO: 7 | 32 nts |
| SEQ ID NO: 31 | Reverse primer corresponding to the reverse complement of nt 2035-2065 from SEQ ID NO: 7 | 31 nts |
| SEQ ID NO: 32 | Forward primer corresponding to nt 1973-2002 of SEQ ID NO: 5 | 32 nts |
| SEQ ID NO: 33 | Reverse primer corresponding to the reverse complement of nt 1-29 of SEQ ID NO: 8 | 29 nts |
| SEQ ID NO: 34 | Nucleotide sequence corresponding to a sequence that spans the first 11 exons of the mouse albumin gene, as set forth in Accession No. c077802366.Contig 3 | 15295 nts |

TABLE A-continued

| SEQUENCE ID | DESCRIPTION | LENGTH |
|---|---|---|
| SEQ ID NO: 35 | Malb353F primer | 23 nts |
| SEQ ID NO: 36 | Malb2382R primer | 43 nts |
| SEQ ID NO: 37 | Malb6310F | 30 nts |
| SEQ ID NO: 38 | Malb13382R | 30 nts |
| SEQ ID NO: 39 | Nucleotide sequence corresponding to a genomic sequence that spans the entire mouse albumin gene, as set forth in Sanger assembly No. F105491 | 27781 nts |
| SEQ ID NO: 40 | albt9649R primer | 28 nts |
| SEQ ID NO: 41 | albt2842F primer | 31 nts |
| SEQ ID NO: 42 | Nucleotide sequence corresponding to nts 88681-130080 of BAC279 | 41400 nts |
| SEQ ID NO: 43 | AGP99R primer | 22 nts |
| SEQ ID NO: 44 | AGP45F primer | 22 nts |
| SEQ ID NO: 45 | AGP49R primer | 22 nts |
| SEQ ID NO: 46 | AGP12F primer | 19 nts |
| SEQ ID NO: 47 | AGP339F primer | 20 nts |
| SEQ ID NO: 48 | AGP403R primer | 21 nts |
| SEQ ID NO: 49 | AGP5'exF | 22 nts |
| SEQ ID NO: 50 | AGP5'exR | 20 nts |
| SEQ ID NO: 51 | AGP3'exF | 20 nts |
| SEQ ID NO: 52 | AGP3'exR | 20 nts |
| SEQ ID NO: 53 | Forward primer corresponding to nt 47283-47314 of SEQ ID NO: 19 | 32 nts |
| SEQ ID NO: 54 | Reverse primer corresponding to the reverse complement of nt 58112-58142 of SEQ ID NO: 19 | 32 nts |
| SEQ ID NO: 55 | Forward primer corresponding to nt 58112-58142 of SEQ ID NO: 19 | 31 nts |
| SEQ ID NO: 56 | Reverse primer corresponding to the reverse complement of nt 66131-66157 of SEQ ID NO: 19 | 27 nts |
| SEQ ID NO: 57 | Forward primer corresponding to nt 84-111 of SEQ ID NO: 9 | 28 nts |
| SEQ ID NO: 58 | Reverse primer corresponding to the reverse complement of nt 2991-3020 in SEQ ID NO: 9 | 30 nts |
| SEQ ID NO: 59 | Forward primer corresponding to nt 898-924 of SEQ ID NO: 11 | 27 nts |
| SEQ ID NO: 60 | Reverse primer corresponding to the reverse complement of nt 3492-3523 of SEQ ID NO: 11 | 32 nts |
| SEQ ID NO: 61 | Forward primer corresponding to nt 26930-26965 of SEQ ID NO: 23 | 36 nts |
| SEQ ID NO: 62 | Reverse primer corresponding to the reverse complement of nt 35227-35254 of SEQ ID NO: 23 | 28 nts |
| SEQ ID NO: 63 | Forward primer corresponding to nt 54-80 of SEQ ID NO: 24 | 27 nts |
| SEQ ID NO: 64 | Reverse primer corresponding to the reverse complement of nt 2738-2764 of SEQ ID NO: 24 | 27 nts |
| SEQ ID NO: 65 | Mouse UGT gene locus | 75798 nts |
| SEQ ID NO: 66 | ugt23275F primer | 31 nts |
| SEQ ID NO: 67 | ugt27501R primer | 30 nts |
| SEQ ID NO: 68 | ugt35967R primer | 21 nts |
| SEQ ID NO: 69 | ugt31170F primer | 23 nts |
| SEQ ID NO: 70 | Human MDR-1 cDNA | 4643 nts |
| SEQ ID NO: 71 | MDR1 primer | 22 nts |
| SEQ ID NO: 72 | 5' flank human MDR contig | 10094 nts |
| SEQ ID NO: 73 | MDR2 primer | 22 nts |
| SEQ ID NO: 74 | MDR3 primer | 23 nts |
| SEQ ID NO: 75 | MDR4 primer | 23 nts |
| SEQ ID NO: 76 | MDR5 primer | 22 nts |
| SEQ ID NO: 77 | MDR6 primer | 28 nts |
| SEQ ID NO: 78 | MDR7 primer | 26 nts |
| SEQ ID NO: 79 | Nucleotide sequence corresponding to reverse complement of nt 36061-38001 of AC005068 BAC clone CTB-137N13 | 1940 nts |
| SEQ ID NO: 80 | MDR8 primer | 29 nts |

DETAILED DESCRIPTION OF THE INVENTION

1. Definitions

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred methods and materials are described. For the purposes of the present invention, the following terms are defined below.

The articles "a" and "an" are used herein to refer to one or to more than one (i.e. to at least one) of the grammatical object of the article. By way of example, "an element" means one element or more than one element.

"agent" means a naturally occurring or synthetically produced molecule which interacts either directly or indirectly with a target member, the level and/or functional activity of which is to be modulated.

"AGP" means the α-acidic glycoprotein family (also abbreviated as AAG).

"Antigen-binding molecule" means a molecule that has binding affinity for a target antigen. It will be understood that this term extends to immunoglobulins, immunoglobulin fragments and non-immunoglobulin derived protein frameworks that exhibit antigen-binding activity.

By "autologous" is meant something (e.g. cells, tissues etc) derived from the same organism.

As used herein, the term "behaviour" when used in relation to a drug includes but is not restricted to the distribution, half-life, efficacy and toxicity of the drug and its metabolites as well as any other physiological or pathological consequences of administering the drug/compound.

As used herein, the term "cis-acting sequence" or "cis-regulatory region" or "regulatory region" or similar term shall be taken to mean any sequence of nucleotides, which when positioned appropriately relative to an expressible genetic sequence, is capable of regulating, at least in part, the expression of the genetic sequence. Those skilled in the art will be aware that a cis-regulatory region may be capable of activating, silencing, enhancing, repressing or otherwise altering the level of expression and/or cell-type-specificity and/or developmental specificity of a gene sequence at the transcriptional or post-transcriptional level.

Throughout this specification, unless the context requires otherwise, the words "comprise", "comprises" and "comprising" will be understood to imply the inclusion of a stated step or element or group of steps or elements but not the exclusion of any other step or element or group of steps or elements.

By "corresponds to" or "corresponding to" is meant a polynucleotide (a) having a nucleotide sequence that is substantially identical or complementary to all or a portion of a reference polynucleotide sequence or (b) encoding an amino acid sequence identical to an amino acid sequence in a peptide or protein. This phrase also includes within its scope a peptide or polypeptide having an amino acid sequence that is substantially identical to a sequence of amino acids in a reference peptide or protein.

By "derivative" is meant a polypeptide that has been derived from the basic sequence by modification, for example by conjugation or complexing with other chemical moieties or by post-translational modification techniques as would be understood in the art. The term "derivative" also includes within its scope alterations that have been made to a parent sequence including additions, or deletions that provide for functionally equivalent molecules. Accordingly, the term derivative encompasses molecules that will modulate function and/or an immune response.

"Drug" refers to any compound, peptide, protein, lipid, carbohydrate or other molecule or moiety which alters or which is intended to alter the physiology or pathology of an organism, organ, tissue or cell.

"Exon" means a region of DNA or the mRNA segment it encodes that is present in the mature mRNA molecule.

The term "foreign polynucleotide" or "exogenous polynucleotide" or "heterologous polynucleotide" refers to any nucleic acid (e.g. a gene sequence) which is introduced into the genome of an animal by experimental manipulations and may include gene sequences found in that animal so long as the introduced gene contains some modification (e.g. a point mutation, the presence of a selectable marker gene, the presence of a loxP site, etc.) relative to the naturally-occurring gene.

The term "gene" as used herein refers to any and all discrete coding regions of the cell's genome, as well as associated non-coding and regulatory regions. The gene is also intended to mean the open reading frame encoding specific polypeptides, introns, and adjacent 5' and 3' non-coding nucleotide sequences involved in the regulation of expression. In this regard, the gene may further comprise endogenous (i.e. naturally associated with a given gene) or heterologous control signals such as promoters, enhancers, termination and/or polyadenylation signals. The DNA sequences may be cDNA or genomic DNA or a fragment thereof. The gene may be introduced into an appropriate vector for extrachromosomal maintenance or for integration into the host.

The term "homologue" in the context of polypeptides refers to a polypeptide of a reference animal, which has a similar sequence to the encoded amino acid sequence of a polypeptide of a different animal. Although two polypeptides are said to be "homologous", this does not imply that there is necessarily an evolutionary relationship between the proteins. Instead, the term "homologous" is defined to mean that the two polypeptides have similar amino acid sequences. In addition, although in many cases polypeptides with similar amino acid sequences will have similar functions, the term "homologous" does not imply that the polypeptides must be functionally similar to each other. When "homologous" is used in reference to polypeptides or peptides, it is recognised that residue positions that are not identical often differ by conservative amino acid substitutions. A "conservative amino acid substitution" is one in which an amino acid residue is substituted by another amino acid residue having a side chain (R group) with similar chemical properties (e.g. charge or hydrophobicity). In general, a conservative amino acid substitution will not substantially change the functional properties of a protein. In cases where two or more amino acid sequences differ from each other by conservative substitutions, the percent sequence identity or degree of homology may be adjusted upwards to correct for the conservative nature of the substitution. Means for making this adjustment are well known to those of skill in the art (see, e.g. Pearson et al. (1994) *Methods in Molecular Biology* 24: 307-31). The following six groups each contain amino acids that are conservative substitutions for one another: 1) Alanine (A), Serine (S), Threonine (T); 2) Aspartic Acid (D), Glutamic Acid (E); 3) Asparagine (N), Glutamine (Q); 4) Arginine (R), Lysine (K), 5) Isoleucine (I), Leucine (L), Methionine (M), Valine (V), and 6) Phenylalanine (F), Tyrosine (Y), Tryptophan (W).

Sequence homology for polypeptides, which is also referred to as sequence identity, is typically measured using sequence analysis software. See, e.g. the Sequence Analysis Software Package of the Genetics Computer Group (GCG), University of Wisconsin Biotechnology Center, 910 University Avenue, Madison, Wis. 53705. Protein analysis software matches similar sequences using measure of homology assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild type protein and a mutein thereof. A preferred algorithm when comparing a reference sequence to a database containing a large number of sequences from different organisms is the computer program BLAST, especially blastp or tblastn (Altschul et al., 1997, *Nucleic Acids Res.* 25: 3389-3402). Preferred parameters for blastp are:

| Expectation value: | 10 | (default) |
|---|---|---|
| Filter: | seg | (default) |
| Cost to open a gap: | 11 | (default) |
| Cost to extend a gap: | 1 | (default |
| Max. alignments: | 100 | (default) |
| Word size: | 11 | (default) |
| No. of descriptions: | 100 | (default) |
| Penalty Matrix: | BLOWSUM62 | |

The length of polypeptide sequences compared for homology will generally be at least about 16 amino acid residues, usually at least about 20 residues, more usually at least about 24 residues, typically at least about 28 residues, and preferably more than about 35 residues. Database searching using amino acid sequences can be measured by algorithms other than blastp known in the art. For instance, polypeptide sequences can be compared using Fasta, a program in GCG Version 6.1. Fasta provides alignments and percent sequence identity of the regions of the best overlap between the query and search sequences (Pearson (1990) *Methods in Enzymology* 183: 63-98). For example, percent sequence identity between amino acid sequences can be determined using Fasta with its default parameters (a word size of 2 and the PAM250 scoring matrix), as provided in GCG Version 6.1. The invention envisions two general types of polypeptide "homologues" Type 1 homologues are strong homologues. A comparison of two polypeptides that are Type 1 homologues would result in a blastp score of less than $1 \times 10^{-40}$, using the blastp algorithm and the parameters listed above. The lower the blastp score, that is, the closer it is to zero, the better the match between the polypeptide sequences. Type 2 homologues are weaker homologues. A comparison of two polypeptides that are Type 2 homologues would result in a blastp score of between $1 \times 10^{-40}$ and $1 \times 10^{-10}$, using the Blast algorithm and the parameters listed above. One having ordinary skill in the art will recognise that other algorithms can be used to determine weak or strong homology.

"Homology" or "identity" or "similarity" refers to sequence similarity between two peptides or polypeptides or between two nucleic acid molecules. Homology can be determined by comparing a position in each sequence, which may be aligned for purposes of comparison. When a position in the compared sequence is occupied by the same base or amino acid, then the molecules are homologous at that position. A degree of homology between sequences is a function of the number of matching or homologous positions shared by the sequences. An "unrelated" or "non-homologous" sequence shares less than 40% identity, though preferably less than 25% identity, with a reference sequence.

"Humanised" means made more human like in function and/or structure but not necessarily identical to the human equivalent. The term "human" as used in reference to polynucleotide or amino acid sequences, may also include any sequence that is human-like in function.

An "intron" is a region of DNA or the mRNA segment that it encodes that is generally spliced out from the primary mRNA and is not present in the mature mRNA molecule.

By "isolated" is meant material that is substantially or essentially free from components that normally accompany it in its native state.

A "knock-in" animal, as used herein, refers to a genetically modified animal in which a specific gene or part thereof is replaced by a foreign gene or DNA sequence.

By "knock-out" animal is meant a genetically modified animal in which a gene is removed or rendered inoperative.

The term "mammal" is used herein in its broadest sense and includes rodents, primates, ovines, bovines, ruminants, lagomorphs, porcine, caprices, equines, canines, and felines. Preferred non-human mammals are selected from the order Rodentia that includes murines (e.g. rats and mice), most preferably mice.

"Messenger RNA" or "mRNA" is the "transcript" produced in a cell using DNA as a template, which itself encodes a protein.

The terms "metabolism", "metabolising" and the like when used in relation to a drug, or to a polypeptide with which it interacts, refer to all aspects of biotransformation of compounds, including but not limited to, the absorption, binding, uptake, excretion, distribution, transport, processing, conversion or degradation of exogenous agents as well as pathological reactions resulting directly or indirectly from administration of the drug.

The term "5' non-coding region" is used herein in its broadest context to include all nucleotide sequences which are derived from the upstream region of an expressible gene, other than those sequences which encode amino acid residues which comprise the polypeptide product of said gene, wherein 5' non-coding region confers or activates or otherwise facilitates, at least in part, expression of the gene.

"Nude mice" are a strain of immuno-incompetent mice also known as athymic mice, often used as a host for growing human tumour cells.

The term "oligonucleotide" as used herein refers to a polymer composed of a multiplicity of nucleotide units (deoxyribonucleotides or ribonucleotides, or related structural variants or synthetic analogues thereof) linked via phosphodiester bonds (or related structural variants or synthetic analogues thereof). Thus, while the term "oligonucleotide" typically refers to a nucleotide polymer in which the nucleotides and linkages between them are naturally occurring, it will be understood that the term also includes within its scope various analogues including, but not restricted to, peptide nucleic acids (PNAs), phosphoramidates, phosphorothioates, methyl phosphonates, 2-O-methyl ribonucleic acids, and the like the exact size of the molecule may vary depending on the particular application. An oligonucleotide is typically rather short in length, generally from about 10 to 30 nucleotides, but the term can refer to molecules of any length, although the term "polynucleotide" or "nucleic acid" is typically used for large oligonucleotides.

"Operably linked" or operably connected and the like refer to a linkage of polynucleotide elements in a functional relationship. A nucleic acid sequence is "operably linked" when it is placed into a functional relationship with another nucleic acid sequence. For instance, a promoter or enhancer is operably linked to a coding sequence if it affects the transcription of the coding sequence. Operably linked means that the nucleic acid sequences being linked are typically contiguous and, where necessary to join two protein coding regions, contiguous and in reading frame. A coding sequence is "operably linked to" another coding sequence when RNA polymerase will transcribe the two coding sequences into a single mRNA, which is then translated into a single polypeptide having amino acids derived from both coding sequences. The coding sequences need not be contiguous to one another so long as the expressed sequences are ultimately processed to produce the desired protein. "Operably linking" a promoter to a transcribable polynucleotide is meant placing the transcribable polynucleotide (e.g. protein encoding polynucleotide or other transcript) under the regulatory control of a promoter, which then controls the transcription and optionally translation of that polynucleotide. In the construction of heterologous promoter/structural gene combinations, it is generally preferred to position a promoter or variant thereof at a distance from the transcription start site of the transcribable polynucleotide, which is approximately the same as the distance between that promoter and the gene it controls in its natural setting; i.e. the gene from which the promoter is derived. As is known in the art, some variation in this distance can be accommodated without loss of function. Similarly, the preferred positioning of a regulatory sequence element (e.g. an operator, enhancer etc) with respect to a transcribable polynucleotide to be placed under its control is defined by the positioning of the element in its natural setting; i.e. the genes from which it is derived.

The term "orthologue" refers to genes or proteins which are homologues via speciation, e.g. closely related and assumed to have common descent based on structural and functional considerations. Orthologous proteins function as recognisably the same or similar activity in different species. The term "paralogue" refers to genes or proteins which are homologues via gene duplication, e.g. duplicated variants of a gene within a genome. See also, Fritch, W M (1970) *Syst. Zool.* 19: 99-113.

"PCR" means polymerase chain reaction, a method for amplifying DNA.

The term "polynucleotide" or "nucleic acid" as used herein designates mRNA, RNA, cRNA, cDNA or DNA. The term typically refers to oligonucleotides greater than 30 nucleotides in length. Polynucleotide sequences are understood to encompass complementary strands as well as alternative backbones described herein.

The terms "polynucleotide variant" and "variant" refer to polynucleotides displaying substantial sequence identity with a reference polynucleotide sequence or polynucleotides that hybridise with a reference sequence under stringent conditions that are defined hereinafter. These terms also encompasses polynucleotides in which one or more nucleotides have been added or deleted, or replaced with different nucleotides. In this regard, it is well understood in the art that certain alterations inclusive of mutations, additions, deletions and substitutions can be made to a reference polynucleotide whereby the altered polynucleotide retains the biological function or activity of the reference polynucleotide. The terms "polynucleotide variant" and "variant" also include naturally occurring allelic variants.

"Polypeptide", "peptide" and "protein" are used interchangeably herein to refer to a polymer of amino acid residues and to variants and synthetic analogues of the same. Thus, these terms apply to amino acid polymers in which one or more amino acid residues is a synthetic non-naturally occurring amino acid, such as a chemical analogue of a corresponding naturally occurring amino acid, as well as to naturally-occurring amino acid polymers.

The term "polypeptide variant" refers to a polypeptide which has some differences in its amino acid sequence as compared to that of a reference polypeptide. Thus, a polypeptide variant is distinguished from a reference polypeptide by the addition, deletion or substitution of at least one amino acid.

By "primer" is meant an oligonucleotide which, when paired with a strand of DNA, is capable of initiating the synthesis of a primer extension product in the presence of a suitable polymerising agent. The primer is preferably single-stranded for maximum efficiency in amplification but may alternatively be double-stranded. A primer must be sufficiently long to prime the synthesis of extension products in the presence of the polymerisation agent. The length of the primer depends on many factors, including application, temperature to be employed, template reaction conditions, other reagents, and source of primers. For example, depending on the complexity of the target sequence, the oligonucleotide primer typically contains 15 to 35 or more nucleotides, although it may contain fewer nucleotides. Primers can be large polynucleotides, such as from about 200 nucleotides to several kilobases or more. Primers may be selected to be "substantially complementary" to the sequence on the template to which it is designed to hybridise and serve as a site for the initiation of synthesis. By "substantially complementary", it is meant that the primer is sufficiently complementary to hybridise with a target nucleotide sequence. Preferably, the primer contains no mismatches with the template to which it is designed to hybridise but this is not essential. For example, non-complementary nucleotides may be attached to the 5' end of the primer, with the remainder of the primer sequence being complementary to the template. Alternatively, non-complementary nucleotides or a stretch of non-complementary nucleotides can be interspersed into a primer, provided that the primer sequence has sufficient complementarity with the sequence of the template to hybridise therewith and thereby form a template for synthesis of the extension product of the primer.

"Probe" refers to a molecule that binds to a specific sequence or sub-sequence or other moiety of another molecule. Unless otherwise indicated, the term "probe" typically refers to a polynucleotide probe that binds to another nucleic acid, often called the "target nucleic acid", through complementary base pairing. Probes may bind target nucleic acids lacking complete sequence complementarity with the probe, depending on the stringency of the hybridisation conditions. Probes can be labelled directly or indirectly.

"Promoter" means a region of DNA, generally upstream (5') of the mRNA encoding region, which controls the initiation and level of transcription. Reference herein to a "promoter" is to be taken in its broadest context and includes the transcriptional regulatory sequences of a classical genomic gene, including a TATA box and CCAAT box sequences, as well as additional regulatory elements (i.e. upstream activating sequences, enhancers and silencers) that alter gene expression in response to developmental and/or environmental stimuli, or in a tissue-specific or cell-type-specific manner. A promoter is usually, but not necessarily, positioned upstream or 5', of a structural gene, the expression of which it regulates. Furthermore, the regulatory elements comprising a promoter are usually positioned within 2 kb of the start site of transcription of the gene. Promoters according to the invention may contain additional specific regulatory elements, located more distal to the start site to further enhance expression in a cell, and/or to alter the timing or inducibility of expression of a structural gene to which it is operably connected.

The term "recombinant polynucleotide" as used herein refers to a polynucleotide formed in vitro by the manipulation of nucleic acid into a form not normally found in nature. For example, the recombinant polynucleotide may be in the form of an expression vector. Generally, such expression vectors include transcriptional and translational regulatory nucleic acid operably linked to the nucleotide sequence.

By "recombinant polypeptide" is meant a polypeptide made using recombinant techniques, i.e. through the expression of a recombinant polynucleotide.

By "reporter molecule" as used in the present specification is meant a molecule that, by its chemical nature, provides an analytically identifiable signal. For example, the detection of a complex comprising an antigen-binding molecule and its target antigen. The term "reporter molecule" also extends to use of cell agglutination or inhibition of agglutination such as red blood cells on latex beads, and the like.

"SCID mice" means a strain of immuno-incompetent mice with Severe Combined Immuno-Deficiency.

The term "sequence identity" as used herein refers to the extent that sequences are identical on a nucleotide-by-nucleotide basis or an amino acid-by-amino acid basis over a window of comparison. Thus, a "percentage of sequence identity" is calculated by comparing two optimally aligned sequences over the window of comparison, determining the number of positions at which the identical nucleic acid base (e.g. A, T, C, G, I) or the identical amino acid residue (e.g. Ala, Pro, Ser, Thr, Gly, Val, Leu, Ele, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e. the window size), and multiplying the result by 100 to yield the percentage of sequence identity. For the purposes of the present invention, "sequence identity" will be understood to mean the "match percentage" calculated by the DNASIS computer program (Version 2.5 for windows; available from Hitachi Software engineering Co., Ltd., South San Francisco, Calif., USA) using standard defaults as used in the reference manual accompanying the software.

"Southern blot" is a method for detecting specific DNA sequences. In brief, a DNA sample is cut with restriction enzymes, electrophoresed, transferred to a membrane and then probed with a labelled DNA fragment of interest.

"Standard mice" means any strain of mice not bearing the genetic modifications of the present invention.

"Stringency" as used herein, refers to the temperature and ionic strength conditions, and presence or absence of certain organic solvents, during hybridisation and washing procedures. The higher the stringency, the higher will be the degree of complementarity between immobilised target nucleotide sequences and the labelled probe polynucleotide sequences that remain hybridised to the target after washing.

"Stringent conditions" refers to temperature and ionic conditions under which only nucleotide sequences having a high frequency of complementary bases will hybridise. The stringency required is nucleotide sequence dependent and depends upon the various components present during hybridisation and subsequent washes, and the time allowed for these processes. Generally, in order to maximise the hybridisation rate, non-stringent hybridisation conditions are selected; about 20 to 25° C. lower than the thermal melting point ($T_m$). The $T_m$ is the temperature at which 50% of specific target sequence hybridises to a perfectly complementary probe in solution at a defined ionic strength and pH. Generally, in order to require at least about 85% nucleotide complementarity of hybridised sequences, highly stringent washing conditions are selected to be about 5 to 15° C. lower than the $T_m$. In order to require at least about 70% nucleotide complementarity of hybridised sequences, moderately stringent washing conditions are selected to be about 15 to 30° C. lower than the $T_m$. Highly permissive (low stringency) washing conditions may be as low as 50° C. below the $T_m$, allowing a high level of mismatching between hybridised sequences. Those skilled in the art will recognise that other physical and chemical parameters in the hybridisation and wash stages can also be altered to affect the outcome of a detectable hybridisation signal from a specific level of homology between target and probe sequences. Other examples of stringency conditions are described in section 3.3.

As used herein, the term "substantially purified" refers to molecules, either nucleic or amino acid sequences, that are removed from their natural environment, isolated or separated, and are at least 60% free, preferably 75% free, and most preferably 90% free from other components with which they are naturally associated. An "isolated polynucleotide" is therefore a substantially purified polynucleotide.

"$t_{1/2}$" means the time needed for a drug to decrease its concentration by one-half (also known as a half-life).

"Transfection" means the process during which a nucleic acid molecule (e.g. a plasmid or DNA fragment) is inserted into a eukaryotic cell. Typically, 2-50% of cells take up the plasmid and express the protein product for ~3 days without incorporating the plasmid DNA or DNA fragment into the cell's chromosomes (=transient transfection). A small proportion of these cells will eventually incorporate the plasmid DNA into their chromosomes and permanently express the protein product (=stable transfection).

The term "transgene" is used herein to describe genetic material that has been or is about to be artificially inserted into the genome of a cell, particularly a mammalian cell of a living animal. The transgene is used to transform a cell, meaning that a permanent or transient genetic change, preferably a permanent genetic change, is induced in a cell following incorporation of exogenous nucleic acid (usually DNA). A permanent genetic change is generally achieved by introduction of the DNA into the genome of the cell. Vectors for stable integration include plasmids, retroviruses and other animal viruses, YACs (yeast artificial chromosome), BACs (bacterial artificial chromosome) and the like. The transgene is suitably derived from animals including, but not limited to, vertebrates, preferably mammals such as rodents, humans, non-human primates, ovines, bovines, ruminants, lagomorphs, porcines, caprines, equines, canines, felines, aves, etc.

As used herein the term "transgenic" refers to a genetically modified animal in which the endogenous genome is supplemented or modified by the random or site-directed integration of a foreign gene or sequence.

The "transgenic animals" of the invention are preferably produced by experimental manipulation of the genome of the germline of the animal. These genetically engineered animals may be produced by several methods including the introduction of a "transgene" comprising nucleic acid (usually DNA) into an embryonal target cell or integration into a chromosome of the somatic and/or germ line cells of a animal by way of human intervention, such as by the methods described herein. Animals, which contain a transgene, are referred to as "transgenic animals". A transgenic animal is an animal whose genome has been altered by the introduction of a transgene.

"UGTs" or "UDPGTs" mean uridine glucuronosyl transferases or uridine diphosphoglucuronosyl transferases.

By "vector" is meant a nucleic acid molecule, preferably a DNA molecule derived, for example, from a plasmid, bacteriophage, or plant virus, into which a nucleic acid sequence may be inserted or cloned. A vector preferably contains one or more unique restriction sites and may be capable of autonomous replication in a defined host cell including a target cell or tissue or a progenitor cell or tissue thereof, or be integrable with the genome of the defined host such that the cloned sequence is reproducible. Accordingly, the vector may be an autonomously replicating vector, i.e. a vector that exists as an extrachromosomal entity, the replication of which is independent of chromosomal replication, e.g. a linear or closed circular plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. A vector system may comprise a single vector or plasmid, two or more vectors or plasmids, which together contain the total DNA to be introduced into the genome of the host cell, or a transposon. The choice of the vector will typically depend on the compatibility of the vector with the host cell into which the vector is to be introduced. The vector may also include a selection marker such as an antibiotic resistance gene that can be used for selection of suitable transformants. Examples of such resistance genes are well known to those of skill in the art.

The term "wild-type" refers to a gene or gene product which has the characteristics of that gene or gene product when isolated from a naturally occurring source. A wild-type gene is that which is most frequently observed in a population and is thus arbitrarily designated the "normal" or "wild-type" form of the gene. In contrast, the term "modified" "variant" or "mutant" refers to a gene or gene product which displays modifications in sequence and or functional properties (i.e. altered characteristics) when compared to the wild-type gene or gene product. It is noted that naturally-occurring mutants can be isolated; these are identified by the fact that they have altered characteristics when compared to the wild-type gene or gene product.

As used herein, underscoring or italicising the name of a gene shall indicate the gene, in contrast to its protein product, which is indicated in the absence of any underscoring or italicising. For example, "AGP-1" shall mean the AGP-1 gene, whereas "AGP-1" shall indicate the protein product of the "AGP-1" gene.

2. Transgenic Mammals of the Invention

The invention provides transgenic, non-primate mammals with a drug metabolism that is more like that of a selected species of primate. In a particular preferred embodiment, the selected species of primate is human and, thus, the transgenic mammal has a drug metabolism that is more human-like than that of the wild-type animal. Such transgenic animals have applications that include but are not restricted to drug screening, preclinical evaluation of drugs and various toxicological and pharmacological studies.

The invention is particularly directed to non-primate transgenic models for expression of polypeptides associated with drug behaviour and/or drug metabolism. More particularly, the invention provides a transgenic non-primate mammal for predicting the likely behaviour of a drug in a selected species of primate, wherein the transgenic mammal expresses at least a portion of a foreign polypeptide that is associated with drug behaviour and/or metabolism and that is expressed naturally in the selected species of primate or in a primate of a different species or that otherwise corresponds to the naturally expressed polypeptide. In one embodiment, a foreign polypeptide is encoded by a nucleotide sequence contained within a transgene, wherein the nucleotide sequence corresponds to a wild-type gene of the selected species of primate or to a wild-type-like genetic material. The wild-type-like genetic material may consist of an entire gene or a cluster of genes or parts thereof. It may also consist of a biologically active fragment of a wild-type gene. The transgene may include genomic DNA or cDNA. In a preferred embodiment, the transgenic mammal is characterised by having at least one human or human-like gene, encoding a drug binding and/or drug metabolising polypeptide, inserted into its genome. Preferably, the transgenic mammal includes stable changes to its germ line sequence with stable integration of the transgene in all or a portion of its cells.

The efficacy of a drug is dependent on the amount of drug that reaches the target tissue and the affinity the compound has for the target. Similarly, the toxicity of a drug depends on the amount of drug or its metabolites that reaches vulnerable tissues. Drugs can be administered by a variety of techniques (e.g. intravenously, intraperitoneally, intramuscularly, orally, subcutaneously), which typically employ a circulatory fluid including, but not limited to, blood, serum, cerebrospinal fluid and lymphatic fluid for drug delivery to the body's tissues. Several drug-metabolising polypeptides exist within circulatory fluids, which can affect the half-life of both a drug and its metabolites. It is often the secondary metabolites and not the drug itself that determines toxicity and can contribute to efficacy. Generally, two types of metabolism can occur: Phase I metabolism usually increases the polarity of the molecule by oxidation, reduction or hydrolysis and Phase II reactions are synthetic in that some conjugation of an endogenous substrate to the drug occurs (e.g. acetylation; see Table 1 and Gilman et al. [Eds], 1985, The Pharmacological Basis of Therapeutics. MacMillan Publishing Co., New York). However, species differences in drug metabolism can occur. For example, in Phase II reactions, it is generally considered that in rats, glucuronidation is preferred over sulfation, whereas in the dog and human, sulfation is preferred, although exceptions occur (Lin and Lu, 1997, *Pharmacol. Rev.* 49: 403-449). A well-known difference in drug metabolism is that despite hydroxylation of amobarbital being a consistent feature amongst humans, dogs, guinea pigs, rats, hamsters and mice, N-glucuronidation appears to be human-specific, whereas the formation of a diol derivative appears to occur only in the non-human species studied (Tang et al., 1980, *Canadian J. Physiol. Pharmacol.* 58: 1167-1169). Numerous enzymes are involved in drug metabolism and these include several cytochrome p450 (CYP) isoforms, esterases, acetyl-transferases, acetylases, glucuronosyl-transferases, glucuronidases, glutathione S-transferases and many more (see for example Table 1). Typically, there are structural differences between drug-metabolising polypeptide homologues from different species, which can affect their drug-metabolising capacities, including their substrate specificity. Thus, in one embodiment, the foreign polypeptide is a drug-metabolising polypeptide. Preferred foreign polypeptides of this type, include polypeptides that facilitate or catalyse a reaction selected from an oxidative reaction including, but not limited to, dealkylation (O- or N-linked), deamination, desulphuration, hydroxylation (aliphatic or aromatic side chains), hydroxylation (N-linked) and sulphoxide derivativisation, a conjugation reaction including, but not limited to, acetylation, glucuronidation, glycine conjugation, methylation (O-, N-, or S-linked) and sulphate conjugation, a hydrolytic reaction including, but not limited to, hydrolysis of esters or amides as well as a reductive metabolism including, but not limited to, a reductive metabolism of azo groups or nitro groups. In a particularly preferred embodiment, the drug-metabolising polypeptide is a Cytochrome P450 (CYP), which is suitably selected from a CYP family including, but not limited to, CYP 1, CYP 2, CYP 3 and CYP 4 families. In a preferred embodiment of this type, the foreign polypeptide is a human or human-like CYP subtype or haplotype, which is preferably, but not exclusively, selected from CYP1A2, CYP2A6, CYP2B6, CYP2C9, CYP2C19, CYP2D6, CYP2E1, CYP3A4, CYP3A5, CYP4A9 or CYP4A11. The expression of endogenous CYPs may be left unaltered or disrupted. In an especially preferred embodiment of this type, the CYP is CYP3A4. In another preferred embodiment, the drug-metabolising polypeptide is a uridine diphosphoglucuronosyl transferase (UGT).

Other examples of drug-metabolising proteins and genes include members of the multidrug-resistance (MDR) and multidrug-resistance-associated protein (MRP) families. For example, the human MDR-1 gene encodes a P-glycoprotein that acts as a drug-efflux pump, essentially limiting the amount of drug that accumulates intracellularly. MRP-1 has a similar, though distinguishable effect.

Circulatory fluids also contain several proteins (and other factors) that possess binding affinity for certain drugs and that thereby affect the distribution, efficacy and/or toxicity of these drugs or their metabolites. Typically, such drug-binding polypeptides from different species have structural differences, which can affect their drug-binding capacities. Thus, in an alternate embodiment, the foreign polypeptide is a drug-binding polypeptide. In a preferred embodiment of this type, the drug-binding polypeptide is serum albumin, which typically binds acidic drugs or drug metabolites. Preferably, the foreign polypeptide is human serum albumin, which suitably comprises the sequence set forth in SEQ ID NO: 2. In a preferred embodiment of this type, the nucleotide sequence of the transgene, which encodes the human serum albumin, comprises the sequence set forth in any one of SEQ ID NO: 1 and 3. Suitably, the endogenous serum albumin of the transgenic mouse, or ancestor thereof, is a mouse serum albumin comprising the sequence set forth in SEQ ID NO: 6. Preferably, the endogenous gene for mouse serum albumin encodes a transcript comprising the sequence set forth in SEQ ID NO: 5. The regulatory polynucleotide suitably comprises a nucleotide sequence that is naturally located upstream of the coding sequence relating to the endogenous gene. Preferably, the regulatory polynucleotide comprises the sequence as set forth in SEQ ID NO: 7.

Another drug-binding polypeptide is α-acidic glycoprotein (also known as AAG, AGP, orosomucoid, ORM), which is hereafter referred to as AGP. The plasma concentration of AGP in healthy individuals ranges from 0.028 to 0.092 g/100 mL, and increases in response to inflammation, infection or cancer (Duche J C et al., 1998, *J Chromatogr B Biomed Sci Appl* 715: 03-109; Duche J C et al., 2000, *Clin Biochem* 33: 197-202; Nakamura H et al., 2000 *Biochem Biophys Res Commun* 276: 779-784). The level of AGP can vary widely in these disease states and can, therefore, profoundly affect the pharmacokinetics of drugs that bind strongly to AGP. Several subtypes of AGP have been described and are encoded by 2-3 tandemly arranged genes, henceforth referred to as AGP-1, AGP-2 and AGP-3. In general, AGP binds neutral and basic compounds, although exceptions to this occur (see Lin and Lu, 1997, *Pharmacol. Rev.* 49: 403-449). Thus, in another embodiment, the drug-binding polypeptide is an AGP. In a preferred embodiment of this type, the foreign polypeptide is a human AGP selected from AGP-1, AGP-2 and AGP-3. Suitably, the human AGP-1 (also known as orosomucoid (ORM)-1) comprises the sequence set forth in SEQ ID NO: 14. In one embodiment, the nucleotide sequence of the transgene, which encodes the human AGP-1, comprises the sequence set forth in SEQ ID NO: 13. Suitably, the human AGP-2 (also known as ORM-2) comprises the sequence set forth in SEQ ID NO: 16. In one embodiment, the nucleotide sequence of the transgene, which encodes the human AGP-2, comprises the sequence set forth in SEQ ID NO: 15. In another preferred embodiment, the expression of an endogenous AGP is altered. Suitably, the endogenous AGP is a mouse AGP selected from AGP-1, AGP-2, AGP-3 and AGP-4. Suitably, the mouse AGP-1 comprises the sequence set forth in SEQ ID NO: 10. Preferably, the endogenous gene encoding the mouse AGP-1 comprises the sequence set forth in SEQ ID NO: 9. Suitably, the mouse AGP-3 comprises the sequence set forth in SEQ ID NO: 12. Preferably, the endogenous gene encoding the mouse AGP-3 comprises the sequence set forth in SEQ ID NO: 11. The regulatory polynucleotide, in this instance, suitably comprises a nucleotide sequence that is naturally located upstream of the coding sequence relating to the gene encoding the foreign polypeptide. Preferably, the regulatory polynucleotide comprises the sequence set forth in SEQ ID NO: 21 and/or 22, which correspond to regulatory polynucleotides located naturally upstream of the human AGP-1 and AGP-2 genes, respectively.

Drug-binding proteins may also include the target of a specific drug. For example, the drug Herceptin is a monoclonal antibody (mAb) that recognises the extracellular domain of human (but not mouse) ErbB2 and has the effect of reducing the growth of ErbB2-overexpessing tumours. Since most mAbs are initially generated in mice, it is not surprising that many mAbs, such as Herceptin and its precursor 4D5 do not recognise the homologous mouse protein. Pre-clinical testing of Herceptin included the treatment of nude mice bearing human tumours. Such studies did not reveal the potential cardiac toxicity of Herceptin because the ErbB2 expressed by the mouse tissues was not recognised by Herceptin. In the context of this drug, ErbB2 is considered a drug-binding protein and the invention, therefore, contemplates any such drug target as a foreign polypeptide of the invention. In a preferred embodiment, the present invention contemplates the humanisation of drug targets such as ErbB2 in the transgenic mammal.

The transgenic mammal may be produced by standard transgenic (random integration) or "knock-in" (site specific) technology and may be associated with the disruption of a host cell gene, in particular, a host gene that is homologous, similar or otherwise corresponding to at least a portion of the transgene. In a preferred embodiment, nucleic acid sequences of the transgene are usually from a human source although it may be suitable to derive one or more genes, or parts thereof from a non-human source; for example, a human-like animal such as a non-human primate. Alternatively, the transgene may be a hybrid/chimera of synthetic polynucleotides and/or human polynucleotides and/or polynucleotide sequences from other origins.

The transgene of interest is selected for its ability to encode a polypeptide associated with drug binding and/or metabolism. The simultaneous use of more than one transgene for insertion into a single embryo is within the scope of this invention.

Preferably, the transgenic animal is selected from the order Rodentia. A preferred transgenic mammal is a mouse, although rats are also of particular utility. However, it will be understood that the present invention is not restricted to these species. For example, the transgenic animal may be a humanised dog or guinea pig.

Useful sequences for producing the transgenic mammals of the invention include, but are not restricted to, open reading frames encoding specific polypeptides or domains, introns, and adjacent 5' and 3' non-coding nucleotide sequences involved in the regulation of expression. Nucleic acid sequences encoding a polypeptide of interest may be cDNA or genomic DNA or a fragment thereof.

A genomic sequence of interest comprises a protein-coding region, for example, as defined in the listed sequences and may include any or all of the introns that are normally present in a native chromosome. It may further include the 3' and 5' untranslated regions found in the mature mRNA.

Regulatory polynucleotides including promoters and other regulatory elements are also used in practising this invention. In some applications, it is preferable to use regulatory elements from the same species as the recipient mammal. In other applications, particularly where a pattern of gene expression in the transgenic mammal is required to be more like that of the selected species of primate, it may be preferable to use regulatory elements of that species, or regulatory elements that are like that species, or a mixture of such regulatory elements and regulatory elements of the transgenic mammal. Thus, in a preferred embodiment, where a more human-like pattern of gene expression is required, it may be preferable to use human or human-like regulatory elements or a mixture of human and host regulatory elements. Preferably, the regulatory elements include genomic sequences, typically but not exclusively of about 1 to about 10 kb in length and corresponding to the sequences upstream of the 5' and possibly downstream of the 3' of the mRNA encoding region of the host mammalian gene or the corresponding human gene to be inserted into the recipient genome. Other regulatory elements may be located in the introns or exons, including the 5' non-translated sequence, 3'-non-translated sequence and protein coding sequence of a gene. Thus, the regulatory polynucleotide suitably comprises transcriptional and/or translational and/or other post-transcriptional control sequences, which include, but are not limited to, a promoter sequence, a 5' non-coding region, a cis-regulatory region such as a functional binding site for transcriptional regulatory protein or translational regulatory protein, an upstream open reading frame, transcriptional start site, translational start site, and/or nucleotide sequence which encodes a leader sequence, termination codon, translational stop site and a 3' non-translated region. A 3' non-translated sequence refers to that portion of a gene comprising a DNA segment that contains a polyadenylation signal and any other regulatory signals capable of effecting mRNA processing or gene expression. The polyadenylation signal is characterised by effecting the addition of polyadenylic acid tracts to the 3' end of the mRNA precursor. Polyadenylation signals are commonly recognised by the presence of homology to the canonical form 5' AATAAA-3' and may include T-rich or GT-rich sequences in close proximity (generally 20-60 nt from AATAAA), although variations are not uncommon. The 3' non-translated regulatory DNA sequence preferably includes from about 50 to 1,000 nucleotide base pairs and may contain mRNA cleavage signals or transcriptional termination sequences as well as translational termination sequences in addition to a polyadenylation signal and any other regulatory signals capable of effecting mRNA processing or gene expression. Constitutive or inducible promoters as known in the art are contemplated by the invention. The promoters may be either naturally occurring promoters, or hybrid promoters that combine elements of more than one promoter. Promoter sequences contemplated by the present invention may be native to the host cell to be introduced or may be derived from an alternative source, where the region is functional in the host cell. The polynucleotides used in the subject invention may encode all or a part of the polypeptides of interest or domains thereof as appropriate. Fragments of the DNA sequence may be obtained by chemically synthesising oligonucleotides in accordance with conventional methods, by restriction enzyme digestion, by PCR amplification (as for example described in U.S. Pat. Nos. 4,683,195, 4,683,202 and 4,965,188 and by Ausubel et al. ("Current Protocols in Molecular Biology", John Wiley & Sons Inc, 1994-1998) or by modifications thereof including long range PCR techniques such as Long Template PCR System (Boehringer Mannheim, Indianapolis, Ind.; see also Skiadas J. et al. 1999, *Mammalian Genome* 10: 1005-1009) and "inverse PCR" (as for example described by Akiyama K. et al. 2000, *Nucleic Acids Research* 28(16)e77 i-vi), or by any other nucleic acid amplification technique such as, but not limited to, strand displacement amplification (SDA) as for example described in U.S. Pat. No. 5,422,252; rolling circle replication (RCR) as for example described in Liu et al., (1996, *J. Am. Chem. Soc.* 118:1587-1594 and International application WO 92/01813) and Lizardi et al., (International Application WO 97/19193); nucleic acid sequence-based amplification (NASBA) as for example described by Sooknanan et al., (1994, *Biotechniques* 17:1077-1080); and Q-β replicase amplification as for example described by Tyagi et al., (1996, *Proc. Natl. Acad. Sci. USA* 93: 5395-5400), etc. For the most part, DNA fragments will be of at least 10 nucleotides, usually at least 18 nucleotides. Such small DNA fragments are useful as primers for PCR or other nucleic acid amplification technique, hybridisation screening, etc. Larger DNA fragments, i.e. greater than 100 nucleotides are useful for production of the encoded polypeptide or part thereof. For use in amplification reactions, such as PCR, a pair of primers will be used. As an example, primers corresponding to regions at the 5' and 3' ends of a DNA segment of interest can be chemically synthesised and used in a PCR reaction with genomic DNA or cDNA as the template, in order to generate and amplify the segment of interest.

3. Nucleic Acid Constructs

The invention provides a nucleic acid construct or vector for producing a transgenic non-primate mammal for predicting the likely behaviour of a drug in a selected species of primate. Advantageously, the construct includes a transgene comprising a nucleotide sequence that encodes at least a portion of a foreign polypeptide that is associated with drug behaviour and/or metabolism and that is expressed naturally in the selected species of primate or in a primate of a different species or that otherwise corresponds to the naturally expressed polypeptide. In an especially preferred embodiment, the transgene comprises a polynucleotide of human origin or a human-like polynucleotide (e.g., from a different species of primate) or other equivalent.

In one embodiment, the nucleic acid construct is a targeting vector comprising two regions flanking said transgene wherein the regions are sufficiently homologous with portions of the genome of said non-primate mammal to undergo homologous recombination with the portions. In a preferred embodiment of this type, the portions comprise a sequence flanking, or contained by, the endogenous gene encoding a polypeptide of the non-primate mammal, which polypeptide is a corresponding homologue of the foreign polypeptide. The transgene preferably comprises a regulatory polynucleotide operably linked to the sequence that encodes at least a portion of the foreign polypeptide. Suitably, the targeting vector comprises a selectable marker gene.

Thus, targeting vectors for homologous recombination will comprise at least a portion of the foreign or heterologous gene of interest, and will include regions of homology to the target locus. DNA vectors for random integration need not include regions of homology to mediate recombination. Conveniently, markers for positive and negative selection are included. Methods for generating cells having targeted gene modifications through homologous recombination are known in the art. For various techniques for transfecting mammalian cells, see Keown et al. (1990, *Methods in Enzymology* 185: 527-537).

It is preferred that regions are selected to be of sufficient length and homology with portions of the genome to permit the homologous recombination of the transgene into at least one allele of the endogenous gene resident in the chromosomes of the target or recipient non-primate cell (e.g. ES cells). Preferably, the regions comprise approximately 1 to 15 kb of DNA homologous to the intended site of insertion into the host genome (more than 15 kb or less than 1 kb of the endogenous gene sequences may be employed so long as the amount employed is sufficient to permit homologous recombination into the endogenous gene).

Suitably, the nucleic acid construct comprises a selectable marker gene. In a preferred embodiment, the nucleic acid construct is a targeting vector comprising a selectable marker gene flanked on either side by regions that are sufficiently homologous with portions of the genome of said non-primate mammal to undergo homologous recombination with those portions. In one embodiment, the portions of the genome correspond to sequences flanking or within the endogenous gene encoding a polypeptide of the non-primate mammal, which polypeptide is a corresponding homologue of the foreign polypeptide. In this instance, the targeting vector is adapted to disrupt the endogenous gene.

The nucleic acid construct may contain more than one selectable maker gene. The selectable marker is preferably a polynucleotide which encodes an enzymatic activity that confers resistance to an antibiotic or drug upon the cell in which the selectable marker is expressed. Selectable markers may be "positive"; positive selectable markers typically are dominant selectable markers, i.e. genes which encode an enzymatic activity which can be detected in any animal, preferably mammalian, cell or cell line (including ES cells). Examples of dominant selectable markers include the bacterial aminoglycoside 3' phosphoransferase gene (also referred to as the neo gene) which confers resistance to the drug G418 in animal cells, the bacterial hygromycin G phosphotransferase (hyg) gene which confers resistance to the antibiotic hygromycin and the bacterial xanthine-guanine phosphoribosyl transferase gene (also referred to as the gpt gene) which confers the ability to grow in the presence of mycophenolic acid. Selectable markers may be 'negative'; negative selectable markers encode an enzymatic activity whose expression is cytotoxic to the cell when grown in an appropriate selective medium. For example, the Herpes simplex virus tk (HSV-tk) gene is commonly used as a negative selectable marker. Expression of the HSV-tk gene in cells grown in the presence of gancyclovir or acyclovir is cytotoxic; thus, growth of cells in selective medium containing gancyclovir or acyclovir selects against cells capable of expressing a functional HSV TK enzyme.

More than one selectable marker gene may be employed with a targeting vector. In this instance, the targeting vector preferably contains a positive selectable marker (e.g. the neo gene) within the transgene and a negative selectable marker (e.g. HSV-tk) towards one or more of said outer regions flanking the transgene. The presence of the positive selectable marker permits the selection of recipient cells containing an integrated copy of the targeting vector whether this integration occurred at the target site or at a random site. The presence of the negative selectable marker permits the identification of recipient cells containing the targeting vector at the targeted site (i.e. which has integrated by virtue of homologous recombination into the target site); cells which survive when grown in medium which selects against the expression of the negative selectable marker do not contain a copy of the negative selectable marker.

The targeting vectors of the present invention are preferably of the "replacement-type"; integration of a replacement-type vector results in the insertion of a selectable marker into the target gene. As demonstrated herein replacement-type targeting vectors may be employed to disrupt a gene resulting in the generation of a null allele (i.e. an allele incapable of expressing a functional protein; null alleles may be generated by deleting a portion of the coding region, deleting the entire gene, introducing an insertion and/or a frameshift mutation, etc.) or may be used to introduce a modification into a gene or replace part or all of the gene. This method may be used when the endogenous or wild-type gene of the mammal is to be disrupted.

Alternatively, the targeting vectors may comprise a recombinase system, which allows for the expression of a recombinase that catalyses the genetic recombination of a transgene. The transgene is flanked by recombinase recognition sequences and is generally either excised or inverted in cells expressing recombinase activity. In an illustrative embodiment, either the Cre-loxP recombinase system of bacteriophage P1 (Lakso et al., 1992, *Proc. Natl. Acad. Sci. USA* 89: 6232-6236; Orban et al., 1992, *Proc. Natl. Acad. Sci. USA* 89: 6861-6865) or the FLP recombinase system of *Saccharomyces cerevisiae* (O'Gorman et al., 1991, *Science* 251: 1351-1355; PCT publication WO 92/15694) can be used to generate in vivo site-specific genetic recombination systems. Cre recombinase catalyses the site-specific recombination of an intervening target sequence or transgcene located between loxP sequences. loxP sequences are 34 base pair nucleotide repeat sequences to which the Cre recombinase binds and are required for Cre recombinase mediated genetic recombination. The orientation of loxP sequences determines whether the intervening transgene is excised or inverted when Cre recombinase is present (Abremski et al., 1984, *J. Biol. Chem.* 259:1509-1514); catalysing the excision of the transgene when the loxP sequences are oriented as direct repeats and catalyses inversion of the transgene when loxP sequences are oriented as inverted repeats.

The vectors used in creating the transgenic non-primate mammal of the invention may also contain other elements useful for optimal functioning of the vector prior to or following its insertion into the recipient non-primate mammalian cell. These elements are well known to those of ordinary skill in the art and are described, for example, in Sambrook et al., Cold Spring Harbor Laboratory Press, 1989. Preferably, the transgene components of the vector are assembled within a plasmid vector such as, for example, pBluescript (Stratagene) and then isolated from the plasmid DNA, prior to transformation of the target cells.

Vectors used for transforming mammalian embryos are constructed using methods well known in the art including without limitation the standard techniques of restriction endonuclease digestion, ligation, plasmid and DNA and RNA purification, DNA sequencing and the like as described, for example, in Sambrook, Fritsch and Maniatis, Eds., *Molecular. A Laboratory Manual*. (Cold Spring Harbor Laboratory Press, Cold Spring Harbor, N.Y. [1989]).

4. Methods of Producing the Transgenic Mammals of the Invention

The transgenic mammals of the present invention are preferably generated by introduction of the targeting vectors into embryonal stem (ES) cells. ES cells can be obtained by culturing pre-implantation embryos in vitro under appropriate conditions (Evans, et al., 1981, *Nature* 292: 154-156; Bradley, et al., 1984, *Nature* 309: 255-258; Gossler, et al., 1986, *Proc. Natl. Acad. Sci. USA* 83: 9065-9069; and Robertson, et al., 1986, *Nature* 322: 445-448). Transgenes can be efficiently introduced into the ES cells by DNA transfection using a variety of methods known to the art including electroporation, calcium phosphate co-precipitation, protoplast or spheroplast fusion, lipofection and DEAE-dextran-mediated transfection. Transgenes may also be introduced into ES cells by retrovirus-mediated transduction or by microinjection. Such transfected ES cells can thereafter colonise an embryo following their introduction into the blastocoel of a blastocyst-stage embryo and contribute to the germ line of the resulting chimeric animal. For review, see Jaenisch (1988, *Science* 240: 1468-1474). Prior to the introduction of transfected ES cells into the blastocoel, the transfected ES cells may be subjected to various selection protocols to enrich for ES cells which have integrated the transgene assuming that the transgene provides a means for such selection. Alternatively, the polymerase chain reaction may be used to screen for ES cells which have integrated the transgene. This technique obviates the need for growth of the transfected ES cells under appropriate selective conditions prior to transfer into the blastocoel.

Alternative methods for the generation of transgenic mammals are known to those skilled in the art. For example, embryonal cells at various developmental stages can be used to introduce transgenes for the production of transgenic mammals. Different methods are used depending on the stage of development of the embryonal cell. The zygote, particularly at the pronucleal stage (i.e. prior to fusion of the male and female pronuclei), is a preferred target for micro-injection. In the mouse, the male pronucleus reaches the size of approximately 20 micrometers in diameter, which allows reproducible injection of 1-2 picoliters (pl) of DNA solution. The use of zygotes as a target for gene transfer has a major advantage in that in most cases the injected DNA will be incorporated into the host genome before the first cleavage (Brinster, et al., 1985, *Proc. Natl. Acad. Sci. USA* 82: 4438-4442). As a consequence, all cells of the transgenic non-primate mammal will carry the incorporated transgene. This will in general also be reflected in the efficient transmission of the transgene to offspring of the founder since 50% of the germ cells will harbour the transgene. Micro-injection of zygotes is the preferred method for random incorporation of transgenes. U.S. Pat. No. 4,873,191 describes a method for the micro-injection of zygotes.

Retroviral infection can also be used to introduce transgenes into a non-primate mammal. The developing non-primate embryo can be cultured in vitro to the blastocyst stage. During this time, the blastomeres can be targets for retroviral infection (Janenich, 1976, *Proc. Natl. Acad. Sci. USA* 73: 1260-1264). Efficient infection of the blastomeres is obtained by enzymatic treatment to remove the zona pellucida (Hogan et al., 1986, in Manipulating the Mouse Embryo, Cold Spring Harbour Laboratory Press, Plainview, N.Y.). The viral vector system used to introduce the transgene is typically a replication-defective retrovirus carrying the transgene (Jahner, D. et al., 1985, *Proc. Natl. Acad Sci. USA* 82: 6927-6931; Van der Putten, et al., 1985, *Proc. Natl. Acad Sci. USA* 82: 6148-6152). Retroviral infection is easily and efficiently obtained by culturing the blastomeres on a monolayer of virus-producing cells (Van der Putten, supra; Stewart, et al., 1987, *EMBO J.* 6: 383-388). Alternatively, infection can be performed at a later stage. Virus or virus-producing cells can be injected into the blastocoele (Jahner, D. et al., 1982, *Nature* 298: 623-628). Most of the founders will be mosaic for the transgene since incorporation occurs only in a subset of cells which form the transgenic mammal. Further, the founder may contain various retroviral insertions of the transgene at different positions in the genome, which generally will segregate in the offspring. In addition, it is also possible to introduce transgenes into the germline, albeit with low efficiency, by intrauterine retroviral infection of the midgestation embryo (Jahner, D. et al., 1982, supra). An additional means of using retroviruses or retroviral vectors to create transgenic mammals known to the art involves the micro-injection of retroviral particles or mitomycin C-treated cells producing retrovirus into the perivitelline space of fertilised eggs or early embryos (PCT International Application Publication No. WO 90/08832) and Haskell and Bowen, 1995, *Mol. Reprod. Dev.* 40: 386).

In selecting lines of any mammalian species to work this invention, they may be selected for criteria such as embryo yield, pronuclear visibility in the embryos, reproductive fitness, colour selection of transgenic offspring or availability of ES cell clones. For example, if transgenic mice are to be produced, lines such as C57/B16 or 129 may be used.

The age of the mammals that are used to obtain embryos and to serve as surrogate hosts is a function of the species used. When mice are used, for example, pre-puberal females are preferred as they yield more embryos and respond better to hormone injections.

Administration of hormones or other chemical compounds may be necessary to prepare the female for egg production, mating and/or implantation of embryos. Usually, a primed female (i.e. one that is producing eggs that may fertilised) is mated with a stud male and the resulting fertilised embryos are removed for introduction of the transgene(s). Alternatively, eggs and sperm may be obtained from suitable females and males and used for in vitro fertilisation to produce an embryo suitable for introduction of the transgene.

Normally, fertilised embryos are incubated in suitable media until the pronuclei appear. At about this time, the exogenous nucleic acid sequence comprising the transgene of interest is introduced into the male or female pronucleus. In some species, such as mice, the male pronuclease is preferred.

Introduction of nucleic acid may be accomplished by any means known in the art such as, for example, microinjection. Following introduction of the nucleic acid into the embryo, the embryo may be incubated in vitro for varied amounts of time prior to reimplantation into the surrogate host. One common method is to incubate the embryos in vitro for 1 to 7 days and then reimplant them into the surrogate host.

Reimplantation is accomplished using standard methods. Usually the surrogate host is anaesthetised and the embryos are inserted into the oviduct. The number of embryos implanted into a particular host will vary, and will usually be comparable to or higher than the number of offspring the species naturally produces. Transgenic offspring of the surrogate host may be screened for the presence of the transgene by any suitable method. Screening may be accomplished by Southern or northern analysis using a probe that is complementary to at least a portion of the transgene (and/or a region flanking the transgene) or by PCR using primers complementary to portions of the transgene (and/or a region flanking the transgene). Western blot analysis using an antibody against the protein encoded by the transgene may be employed as an alternative or additional method for screening.

Alternative or additional methods for evaluating the presence of the transgene include without limitation suitable biochemical assays such as enzyme and/or immunological assays, histological stains for particular markers or enzyme activities and the like.

Progeny of the transgenic mammnals may be obtained by mating the transgenic mammal with a suitable partner or by in vitro fertilisation using eggs and/or sperm obtained from the transgenic mammal. Where in vitro fertilisation is used, the fertilised embryo is implanted into a surrogate host or incubated in vitro or both. Where mating is used to produce transgenic progeny, the transgenic mammal may be back-crossed to a parental line, otherwise inbred or cross-bred with mammals possessing other desirable genetic characteristics. The progeny may be evaluated for the presence of the transgene using methods described above, or other appropriate methods.

Although the foregoing discussion has been made with reference to several methods for producing transgenic mammals, it will be understood that the present invention is not predicated on, or limited to, any one of these methods but instead contemplates any suitable means for producing genetically modified mammals whose germ cells or somatic cells contain a transgene as broadly described above.

5. Uses of Genetically Modified Mammals

The transgenic mammals of this invention are used in place of, or in addition to, the standard mammals from which they are derived. A list of example techniques is provided below, which describe various uses of the trangenic mammals of the invention. These techniques include pharmacokinetic assays, pharmacodynamic assays (including measurement of efficacy), toxicological assays, as well as studies of absorption, distribution, excretion and metabolism. When used in place of standard mammals, the transgenic mammals provide data that are more predictive of a drug's behaviour in a selected species of primate, particularly humans. When used in addition to standard mammals, the differences between transgenic and standard mammals, with respect to drug behaviour, indicate the potential role of the transgene in the metabolism of the specific drug under study.

The transgenic mammals described in this invention can be used in several standard applications in a manner analogous to the use of normal mammals or mammals bearing other genetic modifications. The general descriptions below are intended to illustrate the possible use of the transgenic mammals of the invention and are not intended to limit the scope of the invention. The descriptions are intended to cover several possible modifications of the general assays, known to those of skill in the art.

For example, transgenic mammals may be administered various doses of a compound (possibly bearing a label such as a radioactive isotope or fluorescent group etc) by a variety of possible routes (intravenously (iv), subcutaneously (sc), intraperitoneally (ip), per os (po), intramuscularly (im), intrathecally or other parenteral routes, or by application to the skin, mucous membranes or by placing the material in the feed or drinking water). The numbers of mice per group typically range from 1 to 20, but the experimenter determines the actual number. Compound can be administered once or many times, and mixtures of compounds may also be administered either concomitantly or sequentially. Analytical methods described are also not intended to be restricting, but are merely illustrative.

5.1 Pharmacokinetic Assays

Such assays determine the elimination and metabolism of compounds within the body of an mammal over a time course. For example, transgenic mammals according to the invention are administered compound and then blood, or other body fluids or tissues, or excrement (urine or faeces) are collected at various time points following administration. Concentrations of compound(s), or metabolites thereof, are determined by an appropriate analytical method (for example, HPLC using spectrophotometric determination of analyte). Kinetic data are then typically analysed by graphical and computational means.

5.2 Pharmacodynamic Assays

Such assays determine the activity of compounds within the body of a mammal, normally over a time course. Following administration, the activity of the compound(s) against the target can either use "whole-body" assays (e.g. blood pressure, respiratory rate, electrocardiogram, electromyogram, neurological activity by measuring electromagnetic pluses, etc.) or by imaging techniques (e.g. positron emission spectroscopy, nuclear magnetic resonance imaging, echography, etc). Activity of the compound can also be determined by biochemical means. This can include either direct measurement of interaction of the compound with the target, or by measurement of an upstream or downstream marker indicative of pharmacodynamic activity. For example, transgenic mammals according to the invention are administered compound and then blood, or other body fluids or tissues, or excrement (urine or faeces) are collected at various time points following the administration. Direct measurement of target or marker activity in biological samples can be made by various means (e.g. enzyme assays to determine target or marker activity, Western blot or ELISA techniques to determine either target abundance and/or activity, Northern blot analysis to determine target or marker mRNA levels etc.). Indirect measurement of the target or marker can include determination of substrate or product levels by various analytical methods (e.g. HPLC using spectrophotometric determination of analyte). Testing of pharmacodynamic activity can also involve challenge to the mammal (e.g. artificially raising blood pressure by chemical or mechanical means, change in diet to promote physiological changes, surgical intervention to produce a disease state, injection of infectious agents etc.). Pharmacodynamic data are then typically analysed by graphical and computational means, and are often correlated to compound levels in the tissues. Included in pharmacodynamic studies is the measurement of drug efficacy in the treatment of disease. For example, the dose required to inhibit tumour growth or eliminate infectious agents.

5.3 Absorption, Distribution, Metabolism and Excretion (ADME) Studies

Such studies typically administer radioactive compound(s) to mammals. Determination of the extent of absorption of the compound(s) into the body can use the approaches described for pharmacokinetic assays. Compound distribution studies determine the distribution of the compound into body tissues and typically use autoradiography of whole-body histological-grade slices. Excretion studies elucidate the routes of compound elimination from the body by determination of compound or metabolite levels in faeces or urine (but can also include extracted body fluids such as bile) as described for pharmacokinetic assays. Metabolism studies determine the nature and quantity of metabolites of the parent compound produced by the mammal. It includes metabolites excreted from the body or those remaining internally. Metabolite quantification and identification can use a variety of analytical techniques (e.g. mass spectrometry).

5.4 Toxicological Assays

Such assays determine the toxic activity of compounds within the body of an mammal over a time course. These assays normally use escalation of dose, either concurrently or sequentially, to groups of mice in order to determine doses where no toxic effects can be observed. These assays can use single or multiple administrations of compound(s), and can last for protracted periods of time (typically two weeks to two years). Following administration, the toxic activity of the compound(s) can be determined by monitoring, by visual inspection, the degree of morbidity (e.g. clinical appearance of the mammal) or mortalities produced, measurement of body weight loss or general activity (e.g. movement, exploratory activity, sleep time etc.), food and water consumption, appearance of the urine and/or faeces. Determination of the toxic activity of the compound(s) can also use "whole-body" assays or by imaging techniques (described above for pharmacodynamic assays). Toxic activity of the compound can also be determined by biochemical means (e.g. determination of gene induction or products of genes associated with general toxicological responses, determination of biological metabolites associated with responses to toxic insult). Histological examination of the body tissues removed at death or at sacrifice of the mammal can also be used to monitor for toxic effects, as can haematological changes in the number or character of circulating cells. Carcinogenicity studies monitor the production of neoplasms or genetic damage likely to lead to cancer during compound treatment. Teratogenic studies determine the effect of compound administration of the development of the foetus.

In order that the invention may be readily understood and put into practical effect, particular preferred embodiments will now be described by way of the following non-limiting examples.

EXAMPLES

Example 1

Obtaining a Knock-In Mouse in which Human Serum Albumin Replaces the Endogenous Mouse Serum Albumin Step 1. Obtaining Human Coding Sequences The human albumin cDNA sequence (XM_031320) is obtained by PCR of a human foetal liver cDNA library, using primers designed from and based on the sequence set forth in GenBank Accession No. XM_031320 [SEQ ID NO: 3]. For example, the two separate PCR reactions described below generate 5' and 3' portions of the gene that overlap across a Bsu36I site. After digestion with Bsu36I, the two halves are joined by ligation into an appropriate vector such as pBluescript (Stratagene), with a neo gene blunt-end ligated into the SmaI site with the BamHI site in the polylinker at the 3' end of the gene. The following primers can be used for performing the PCR reactions:

5' portion of human ALB CDNA: Forward primer (from start codon, overlapping BstEII site=nt 39-63 of SEQ ID NO: 3); HALB1F=(5') ATGAAGTGGGTAACCTTTATTTCC (3') [SEQ ID NO: 26]. Reverse primer (from end of coding region, including stop codon and overlapping Bsu36I site; =reverse complement of nt 1843-1869 of SEQ ID NO: 3; HALB3R=(5') TTATAAGCCTAAGGCAGCTTGACTTGC (3') [SEQ ID NO: 27]. The fragment is cut with BstEII (links to 3' end of 5' mouse flanking sequence) and Bsu36I (links to 3' portion of human ALB gene).

3' portion of human ALB gene: Forward primer (overlapping stop codon, Bsu36I site and HALB3R, =nt 1855-1885 of SEQ ID NO: 3); HALB5F=(5') CCTTAGGCTTATAACAT-CACATTTAAAAGC (3')) [SEQ ID NO: 28]. Reverse primer (3' of $2^{nd}$ polyadenylation signal, =reverse complement of nt 2197-2216 of SEQ ID NO: 3); HALB4R=(5') AACTTA-GAAGAGTATTAATG (3')) [SEQ ID NO: 29]. The fragment is ligated in the appropriate orientation (3' end nearest the SpeI site of the vector) into the pGEM-Teasy vector, cloned and excised with SpeI and Bsu36I. The SpeI site permits cloning into the SpeI site of the pBluescript-based targeting vector and the 5' BstEII site allows ligation to the 3' end of the 5' portion of the human cDNA described above.

Additional 3' sequences that extend beyond the mRNA-encoding region (and may facilitate efficient polyadenylation) can be obtained by using an extended version of HALB4R that contains additional downstream (genomic) sequences. For example, (5') TCATAATGTCAAAATAT-TATTTTGAATGTTTATAATCCATAACTTAGAAGAGTA TTAATG (3') i.e. reverse complement of nt 18889-18830 of SEQ ID NO: 1.

An alternative approach is the screening of human liver cDNA libraries using probes based on coding sequences within SEQ ID NO: 3. Full-length albumin coding sequences can then be derived from the positive clones using standard molecular biology techniques (e.g., restriction enzyme digestion and/or PCR). Full length cDNA corresponds to human ALB mRNA as set forth in SEQ ID NO: 3.

Step 2. Obtaining the Flanking Mouse Genomic Sequences

Option A

The 5' mouse flanking sequence is shown in SEQ ID NO: 7 and includes the mouse albumin promoter that will drive expression of the transgene. This sequence is obtained by PCR of mouse genomic DNA using as a forward primer nt 1-32 of SEQ ID NO: 7 (J04738) i.e., (5') AAGCTTGAAAA-CAGGACTGCCTTAGAAGTAAC (3')) [SEQ ID NO: 30] and as a reverse primer the reverse complement of nt 2035-2065 from SEQ ID NO: 7 (J04738) i.e., (5') GTGGGGT-TGATAGGAAAGGTGATCTGTGTGC (3') [SEQ ID NO: 31], (within the 5'-UTR of mouse albumin gene).

The 3' mouse flanking sequence is also generated by PCR of mouse genomic DNA. The forward primer is derived from nt 1973-2002 of SEQ ID NO: 5 (AJ011413) i.e., (5') TTTAAACATTTGACTTCTTGTCTCTGTGCTGC (3') [SEQ ID NO: 32], (corresponding to the 3'-UTR of mouse albumin mRNA). The reverse primer is the reverse complement of nt 1-29 of SEQ ID NO: 8 (J05246) i.e., (5') GTGTCTAGAGGTCCAGACATGTTTGCTAA (3') [SEQ ID NO: 33], (mouse alpha fetoprotein [AFP] 5' promoter region). This corresponds to a region which lies ~12.6 kb downstream of the mouse ALB gene. Thus the described PCR reaction will generate an amplicon of ~12.6 kb that corresponds to the region immediately 3' of the mouse ALB gene. This amplicon can be used directly for construction of the targeting vector. Alternatively, the amplicon can be used to derive a smaller 3' flanking sequence (e.g., by subcloning into a vector such as pBluescript (Stratagene) followed by restriction enzyme digestion). Smaller flanking regions are often preferable when utilising large genomic coding sequences.

Option B

A contig of 15295 bp that spans the first 11 exons of the mouse albumin gene (sequence ID c077802366) is schematically illustrated in FIG. 1 and its sequence is set forth in SEQ ID NO: 34. Also included in this contig is about 2 kb upstream of the gene that contains most of the promoter sequence. A 5' arm which spans the mouse promoter region and the 5'UTR of the mouse albumin gene from position 353-2382 on the contig is generated by PCR using the primers below and mouse genomic DNA as a template. The fragment is ligated in the appropriate orientation (5' end nearest the SacII site of vector) into the pGEM-Teasy vector, cloned and excised with NotI and BstEII. The NotI site permits cloning into the NotI site of the pBluescript-based targeting vector and the 3' BstEII site allows ligation to the 5' end of the human albumin cDNA described above. The 5' flank, together with both halves of the cDNA are ligated into the targeting vector cut with NotI and SpeI. The resultant construct contains the mouse promoter and 5' UTR linked to the human coding region and human 3'UTR. Although the first 3-6 codons are of mouse origin, these codons are 100% identical in human and mouse albumin mRNA.

Examples of useful primers for the above PCR amplification include: Malb353F (5') CATATAGGACGAGTGC-CCAGGAG (3') (~2 kb upstream of start codon; =nt 353-375 of SEQ ID NO: 34) [SEQ ID NO: 35]; and Malb2382R (5') GGTTACCCACTTCATTTTGCCAGAG-GCTAGTGGGGTTGATAGG (3') [SEQ ID NO: 36] (which overlaps a BstEII site, the start codon and a portion of the 5'UTR; i.e. reverse complement of nt 2354-2397 of SEQ ID NO: 34 with the 5' end of the oligo containing the reverse complement of human sequence nt 78-93 of SEQ ID NO: 3).

A 3' arm position 6310 to position 13382 in the contig) is generated by PCR of mouse genomic DNA using the following oligos as primers:

```
Malb6310F
                                         [SEQ ID NO:37]
(5')  CCGCTCGAGTGAAGTTGCCAGAAGACATCC  (3');
and Malb13382R
                                         [SEQ ID NO:38]
(5')  ACGCGTCGACAAGAGACGATTCACCCAACC  (3').
```

The resultant 7 kb fragment, which extends from the middle of exon 5 downstream to near the end of intron 10, is cut with XhoI (site exists in forward primer) and SalI (site exists in reverse primer) and ligated into the SalI site of the targeting vector.

Figure 2:
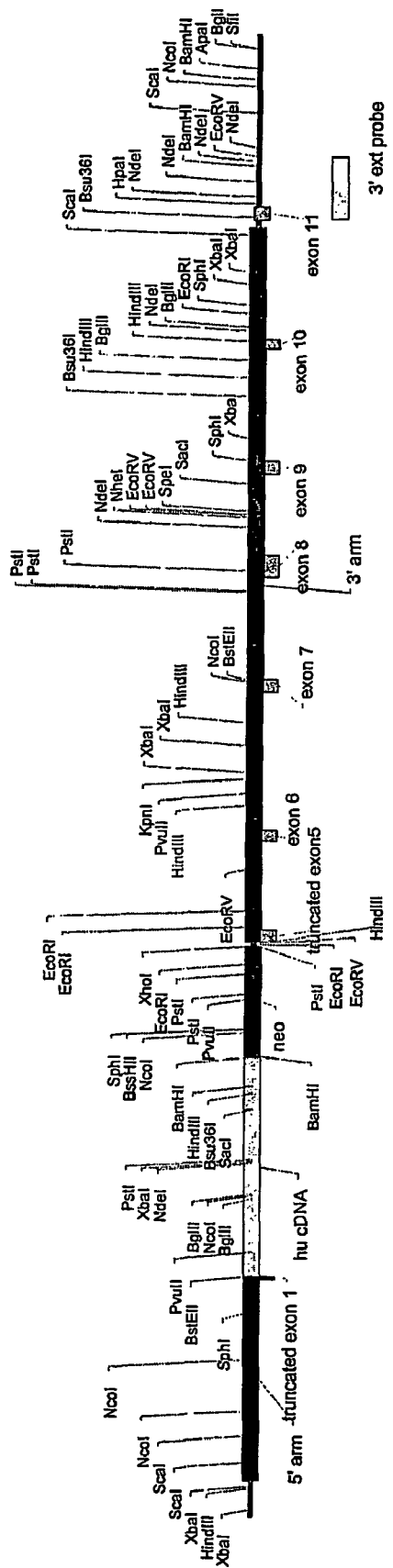
FIG. 2 is a schematic representation showing a linear map of one embodiment of a mouse ALB targeting construct for replacing the mouse ALB gene with a human ALB cDNA.

Following homologous recombination, this targeting vector is capable of replacing mouse ALB exons 1-4, with the human ALB cDNA, which includes a polyadenyation signal that prevents expression of the remaining undeleted portion of the mouse ALB gene (see FIG. 2).

An alternative strategy involves amplifying a fragment downstream of the entire mouse albumin gene thus deleting the whole gene locus. Using a 27781 bp mouse contig (Sanger Assembly No. F 105491, as set forth in SEQ ID NO: 39), primers can be designed to amplify a 3' arm of about 7 kb; e.g. as follows: Reverse primer; albt9649R (5') AGCTCTC-GAGAATCCCTGCCTTTCCTCC (3') [SEQ ID NO: 40]; and Forward primer albt2842F (5') AGTAGTCGACGA-CAGCAGATGCCT GTGATCC (3') [SEQ ID NO: 41].

The reverse primer is the reverse complement of nt 9667-9649 from SEQ ID NO: 39. The forward primer is nt 2842-2862 from SEQ ID NO: 39. The resultant 7 kb fragment, is cut with XhoI (site exists in forward primer) and SalI (site exists in reverse primer) and ligated into the SalI site of the targeting vector.

Step 3. Assembling the Transgene Vector

The components obtained in steps 1 and 2 are assembled within a plasmid such as pBluescript (Stratagene), in the following order; (5' mouse flanking)—(human ALB)—(neo)—(3' mouse flanking). The neomycin resistance gene driven by the TK promoter is blunt-end ligated into the SmaI site of pBluescript with the 3' end of the gene near the BamHI site. Where human albumin cDNA is used, the resultant plasmid is then cleaved with NotI/SpeI and ligated with the 5' arm containing the mouse promoter (5' NotI—BstEII 3'), the 5' portion of the human gene (BstEII—Bsu36I), and the 3' portion of the human gene (5' Bsu36I—SpeI). Clones containing the correct sequences are then cut with SalI and the 3' arm is ligated in.

Insertion of a negative selection marker such as HSV-tk at the 3' end of the 3' flanking sequence is optional but assists in distinguishing homologous recombinants (which lose the HSV-tk) from random integrants (which maintain the HSV-tk and are thus sensitive to gancyclovir).

Step 4. Inserting the Transgene into ES Cells

When the 3' arm fragment is inserted in the correct orientation, a unique SalI site is preserved at the 3' end of the construct and can be used to linearise the targeting construct prior to electroporation in ES cells. It is then transfected into mouse embryonic stem (ES) cells, which are later selected in growth medium containing G418 to isolate cells that have incorporated the foreign DNA into their nuclear material (for a detailed protocol, see Examples 6 and 7. In the case where the HSV-tk gene is also used, the cells are further selected in gancyclovir to remove cells that integrated the transgene randomly rather than by homologous recombination. Individual clones are then grown and each clone is split into multiple plates. Homologous recombinants are confirmed by Southern blotting or PCR. This is done by screening with external Southern blot probes or external PCR primers at both ends of the construct to ensure that the construct has been targeted correctly at both ends.

In an alternative strategy, the neo cassette is flanked by loxP sites and can be removed by transient transfection of the ES cells with a Cre-expression plasmid or removed from subsequent generations of mice through interbreeding with Cre-expressing transgenic mice. In another alternative strategy, the neo cassette is flanked by FRT sites and can be removed by transient transfection of the ES cells with a FLP-expression plasmid or removed from subsequent generations of mice through interbreeding with FLP-expressing transgenic mice.

Step 5. Blastocyst Injection

ES cells from one or more correct clones are injected into mouse blastocysts which are then implanted into pseudo-pregnant mice. Implantation is performed on anaesthetised mice using a dissecting microscope. A pseudo pregnant female mouse is anaesthetised with 0.017 to 0.020 mL/g body weight of avertin injected IP. The mouse is placed under the dissecting microscope and an incision area is disinfected with 70% ethanol. An ovary is exteriorised and the bursal sack that surrounds the ovary and the oviduct is carefully pulled open. The ovary and oviduct are separated to expose the opening of the oviduct. The mouse blastocyst is loaded into a reimplantation pipette and the tip of the pipette is inserted several millimetres into the infimdibulum and emptied into the oviduct. The ovary is then returned to the peritoneum and the body wall and skin is sutured.

Step 6. Selecting Transgenic Mice

Preferably, the ES cells and blastocysts are obtained from different strains of mice such that the chimeric founder ($F_0$) mice can be identified by coat colour. When mature, $F_0$ mice are mated with wild type mice to obtain germline transmission of the targeted allele and the $F_1$ mice containing the desired genetic modification are identified by colour and confirmed by Southern blot and/or PCR and/or DNA sequencing. The heterozygote $F_1$ mice can be assayed at this stage for expression of the human albumin gene by extracting RNA from the liver of these mice and assaying expression by RT-PCR or Northern blot analysis with a human gene specific probe.

Subsequent generations of transgenic mice are preferably bred to homozygosity to provide mice that express human serum albumin and do not express mouse serum albumin.

An alternative strategy would involve the fusing of the mouse promoter lacking the mouse 5' UTR with the entire human albumin cDNA including the human 5'UTR and the human 3'UTR. Another alternative strategy would involve fusing the human coding sequence with the 5'UTR and 3'UTR of the mouse albumin gene.

In an alternative strategy a targeting vector is built without human albumin cDNA sequence. The construct is used for targeting the mouse albumin gene and knocking out expression of the gene. Once targeted cells no longer expressing the mouse albumin are identified, a human BAC spanning the albumin locus RP11-580P21 (sequence ID: AC108157), which is obtainable from Children's Hospital Oakland Research Institute (CHORI), is transfected in together with $\frac{1}{50}^{th}$ amount of a selectable marker such as the puromycin- or hygromycin-resistance genes. The cells are selected and individual colonies picked, expanded and samples frozen. DNA is prepared from individual clones and screened for presence of the transgene and copy number. A single copy is preferable. If necessary inverse PCR can be carried out by standard protocols to identify integration site of the transgene and to ensure that the integration has not disrupted another gene.

In an alternative strategy, a fragment can be digested out of the above-mentioned BAC that spans the entire human albumin locus. A possible enzyme would be Eco47III that digests the BAC about 8 kb upstream of the beginning of the gene and about 2 kb downstream of the gene. This fragment could be isolated by pulse field gel electrophoresis (PFGE) and cloned into a suitable vector with a selectable marker, which can then be used for transfection into the ES cells in which the mouse albumin gene has been deleted. An alternative method includes random integration of the human albumin gene by embryo injection and may or may not be combined with disruption of the endogenous mouse serum albumin gene.

Example 2A

Obtaining a Mouse in which Human AGP Replaces the Endogenous Mouse AGP

Knock-Out Mouse Genes by Homologous Recombination, then Randomly Integrate Human Genes:

Step 1. Design of a Targeting Construct to Knockout the Entire Mouse AGP Locus

Figure 3:
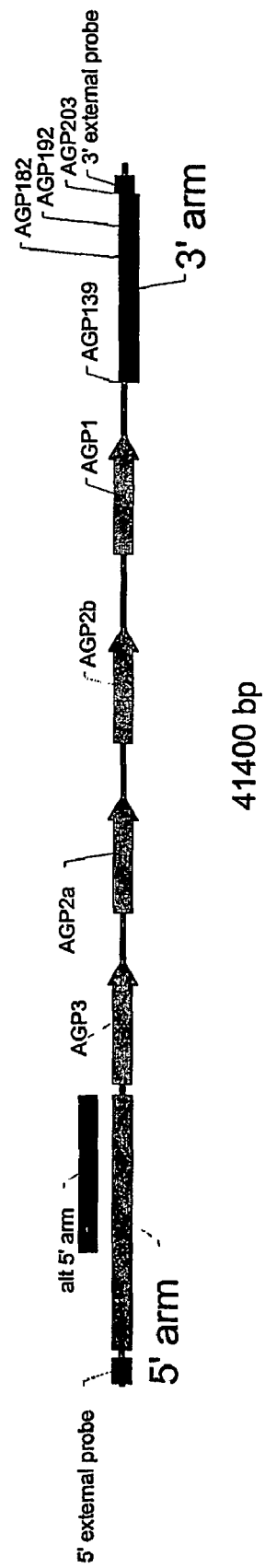
FIG. 3 is a schematic representation showing a linear map of the mouse AGP locus.

A BAC sequence has been identified that spans the AGP gene locus in mouse. The BAC is mouse chromosome 4 BAC279 (GenBank Accession No. AF336379). The region has been mapped and four genes (or pseudogenes) have been identified. They span a region extending from approximately 98880 to 120991 in this sequence. A 41400 bp region spanning from position 88681 to position 130080 can be taken from this BAC sequence and used for preparation of the targeting construct. A linear map of this region is shown in FIG. 3 and the sequence relating thereto is set forth in SEQ ID NO: 42.

The mouse 5' arm and 3' arm for the targeting vector are obtained from regions 5' to the 4 gene locus and 3' to it, respectively. Such sequences are obtained by PCR using BAC279 or mouse genomic DNA as a template. Examples of useful primers are summarised below:

| | Oligonucleotides for amplifying 5' and 3' arms of AGP locus | | | |
|---|---|---|---|---|
| Oligo name F = forward R = reverse | Start position in seq id no: 42 | End position in seq id no: 42 | Sequence of primer in the 5'-3' direction | Seq id no: | RE site at end |
| AGP99R | 9903 | 9882 | TCATTACAACCCCT CTTTAACC | 43 | SpeI |
| AGP45F | 4583 | 4604 | GGACACCAACTACT GACATAGG | 44 | SpeI |
| AGP49R | 4921 | 4900 | CCACAGAGATGCTA CTGACACC | 45 | SpeI |
| AGP12F | 1227 | 1245 | GCAGAAGGTGAGAA GATGG | 46 | SpeI |
| AGP339F | 33991 | 34010 | TCCAAAATGCTTCA GAGACC | 47 | SalI |
| AGP403R | 40353 | 40333 | AGTGACCAGAGAGC AGAGACC | 48 | SalI |
| AGP5' exF | 85 | 106 | GCTACCTCCCACTG TGAAATCG | 49 | N/A |
| AGP5' exR | 962 | 943 | CACAAGCAGTATGC AGGTGG | 50 | N/A |
| AGP3' exF | 40365 | 40384 | AGTCTGGGTACATC CCGAGG | 51 | N/A |
| AGP3' exR | 40982 | 40963 | CAGACACATGCCAC TCCACC | 52 | N/A |

Primers AGP5'EXF and AGP5'EXR amplify an 877 bp 5' external probe for screening targeted clones. Primers AGP3'EXF and AGP3'EXR amplify a 617 bp 3' external probe for screening targeted clones.

In the case of the 5' arm, two separate PCR reactions are performed; with primers AGP12F and AGP49R to give a 3.7 kb fragment and with primers AGP45F and AGP99R to give a 5.4 kb fragment. Each fragment is digested with SpeI and HindIII. The SpeI site is located at the end of the oligonucleotides and HindIII is around position 4700. The two SpeI-HindIII fragments are ligated together in the correct orientation and cloned into the SpeI site of a pBluescript vector in which the neo gene has been blunt-end ligated into the SmaI sites, with the 3' end of the gene near the BamHI site. The 5' arm is 8.7 kb long.

Figure 4:
FIG. 4 is a schematic representation showing a linear map of one embodiment of a mouse AGP targeting construct for knocking out the mouse AGP locus.

The 3' arm is amplified with primers AGP339 and AGP403 to give a 6.4 kb fragment with a SalI site at each end. The fragment is digested and cloned into the SalI site of the pBluescript vector described above. A linear map of the resulting construct is shown in FIG. 4.

Step 2. Targeting the Mouse AGP Locus

As per example 1, step 4.

Step 3. Introducing Human Coding Sequences

Option A Introducing Entire BAC Clone

The human AGP genes (ORM1 and ORM2) are located on BAC clone RP11-82I1, which is obtainable from the CalTech human BAC library B Sanger Sequencing Centre, Cambridge, U.K. [bA82I1, see also GenBank Accession No. AL356796]. In one strategy, the entire BAC clone or a large fragment thereof containing the human AGP genes is randomly incorporated into the genome of ES cells, in which the mouse AGP locus has been disrupted by homologous recombination of the construct described above (without human sequences in targeting vector). The BAC is transfected in together with $1/50^{th}$ amount of a selectable marker such as puromycin or hygromycin, cells are selected and individual colonies picked, expanded and frozen. DNA is prepared from individual clones and screened for presence of the transgene and copy number. If necessary, inverse PCR can be carried out by standard protocols to identify integration site of the transgene and to ensure that the integration has not disrupted another gene.

Option B Introducing A Portion of the BAC Clone Containing Human AGP Genes

In an alternative strategy, the region of the BAC containing the human AGP genes and flanking sequences are subcloned into a vector containing a selectable marker other than neo. A portion of RP11-82I1 (nt 48000 to 78000) contains the human AGP locus whose sequence is set forth in SEQ ID NO: 19.

Positions of regions in the two genes are as follows:

|  | AGP-1 | AGP-2 |
| --- | --- | --- |
| ATG | 6315 | 13086 |
| stop codon | 9523 | 16300 |
| end of mRNA (polyA) | 9647 | 16424 |

PCR primers for amplifying the desired fragments can be identified from this contig. (SEQ ID NO: 19). Alternatively, useful RE sites for cutting out the relevant fragments can be obtained from the restriction map of this contig. For example XbaI cleaves at positions: 3060, 9883, 16600, 29368.

Digesting BAC clone RP11-82I1 with XbaI will give many fragments, but among them there will be two fragments of 6823 bp and the other of 6717 bp which are the AGP-1 and AGP-2 genes respectively together with around 3 kb of upstream sequence. The two fragments are assembled in the correct orientation in the XbaI, SpeI or NheI sites of a suitable vector containing an alternative selectable marker to neo. Flanking these cloning sites (and the selectable marker gene) are unique RE sites (e.g. SgrAI) that facilitate removal of the assembled (13.5 kb) human sequence (containing ~3 kb of sequence 5' to the AGP-1 gene).

In an alternative strategy a larger fragment can be subcloned from the BAC containing more 5' sequence in case the transcriptional regulatory elements extend further upstream. For example, XhoI cuts at position 307 and SpeI cuts at positions 10128 and 16905 as set forth in SEQ ID NO: 19. Digesting with XhoI and SpeI will give two fragments that can be cloned sequentially into a suitable vector and thus give a 16.6 kb genomic fragment containing ~6 kb of sequence 5' to the AGP-1 gene.

Example 2B

Knock-Out Mouse genes and Insert Human Genes at Same Locus by Homologous Recombination—Procedure 1

The preferred strategy involves incorporating the human AGP sequences into a mouse AGP targeting vector, between the 5' arm and the neo gene. In other words, create a knock-in vector that, upon homologous recombination, both disrupts expression of the mouse AGP genes and also inserts the human AGP genes at the same locus. This strategy requires construction of a large vector. There is evidence in the literature that low copy number vectors such as pBR322 are more amenable to the cloning of large fragments of above 20 kb. The low copy number aids stability of the relatively large plasmids. In a non-ligation mediated cloning procedure, it was shown that high copy vectors such ColE1-derived pBluescript were capable of cloning up to 25 kb whilst pBR322 were capable of up to 80 kb (Lee et al. 2001, *Genomics* 73: 56-65).

The 5' and 3' arms together with the neo gene and the human genomic fragment are cloned in the correct orientation into a single vector, such as pBR322. To facilitate cloning, it is preferable to reduce the size of the arms relative to those described in Example 2A.

Step 1. Obtaining Human Coding Sequences

The human AGP gene cluster, containing AGP-1, AGP-2 and both promoter regions is obtained by PCR of either human genomic DNA or the BAC clone containing SEQ ID NO: 19, which is available from the CalTech human BAC library B and the Sanger Centre, Cambridge, UK and is identified as clone RP11-82I1 (bA82I1). The PCR primers are designed from and based on SEQ ID NO: 19 (complete human AGP gene cluster, derived from GenBank Accession No. AL356796). As with Example 1, the preferred method involves two separate PCR reactions to generate the 5' and 3' halves of the desired human sequence, and then joining the two fragments. Appropriate primers include:

5' half (AGP1): Forward primer (~6 kb upstream of AGP-1 translation start codon), =nt 47283-47314 of SEQ ID NO: 19 (AL356796). i.e. (5') CAGGCTGCGCCTGGG ATCTCTA-CACTCGAGCA (3') [SEQ ID NO: 53]. Reverse primer (3' of AGP-1 polyadenylation signal, =reverse complement of nt 58112-58142 of SEQ ID NO: 19 [AL356796]); i.e. (5') CTG-CACATACGGAATAGATGGAACAACTCAG (3') SEQ ID NO: 54].

3' half (AGP2): Forward primer=nt 58112-58142 of SEQ ID NO: 19 [AL356796]); i.e. (5') CTGAGTTGTTCCATC-TATTCCGTATGTGCAG (3') SEQ ID NO: 55]. (~2 kb upstream of AGP2 translation start codon). Reverse primer (3' of AGP2 polyadenylation signal, =reverse complement of nt 66131-66157 of SEQ ID NO: 19 [AL356796]); i.e. (5') CCTTTGCCTATCTCAGAACCATAAATC (3') SEQ ID NO: 56].

The 5' and 3' halves obtained by PCR can be spliced together to generate the human AGP-1-AGP-2 transgene (SEQ ID NO: 20) for 'knocking in' to the mouse genome.

An alternative strategy involves obtaining the human AGP genes by restriction enzyme digestion of BAC clone RP11-82I1 (bA82I1) and using it in the subsequent steps. Alternatively, the entire BAC clone is microinjected into mouse embryos (random integration) and the resultant transgenic mice are later bred with AGP knock-out mice generated via homologous recombination. For more details on this type of 2-step procedure, see Example 3.

Step 2. Obtaining the Flanking Mouse Genomic Sequences

In this example, the transgene contains the human promoters that will drive expression of human AGP. Therefore, it is not necessary for the human polynucleotide sequences to be functionally combined with a mouse promoter as in Example 1. However, it is still preferable to functionally inactivate the mouse AGP genes. Therefore, the 5' flanking mouse sequence is comprised of a 5' portion of mouse AGP-1 and the 3' flanking mouse sequence is comprised of the 3' portion of mouse AGP-3, such that homologous recombination results in deletion of the entire mouse AGP-2 gene, the 3' portion of mouse AGP-1 and the 5' portion of mouse AGP-3. The introduction of small mutations into the promoter and/or first exon of mouse AGP1, ensures the functional disruption of this gene.

The 5' mouse flanking sequence is obtainable by PCR of mouse genomic DNA, using as a forward primer, nt 84-111 of SEQ ID NO: 9 (M17376; 5' flank of AGP-1) i.e. (5') CTACATTTTCAACTCAGATTCACCCCTC (3') [SEQ ID NO: 57]. The reverse primer is the reverse complement of nt 2991-3020 in SEQ ID NO: 9 (M17376; intron 5 of AGP-1) i.e. (5') ATGGCTGCTGGCATGTCTGTATGGCAGGCC (3') [SEQ ID NO: 58]. The resultant PCR product, which represents nt. 84-3020 of SEQ ID NO: 9, may then be mutated at critical sites using standard techniques, in order to ensure that a functional, though truncated, mouse AGP-1 protein is not produced. The mutations include any or all of the following; a) disruption of the GC box (nt 546-554 of SEQ ID NO: 9) and TATA box (nt 562-567 of SEQ ID NO: 9); b) point mutation of the translation start codon (nt 634-636 of SEQ ID NO: 9) and preferably also the ATG at nt 658-660 of SEQ ID NO: 9; c) introduction of a stop codon in the first exon, such as by changing nt 680 of SEQ ID NO: 9 from T to A. An example of a method for introducing mutations is "Fusion PCR", which utilises primers with the desired nucleotide mismatches or 5' tails encoding the mutation. Complementary forward and reverse primers covering the mutation are generated and used in separate PCR reactions. One reaction contains the 5' forward primer (nt 84-111 of SEQ ID NO: 9 in this example) and the mutant reverse primer to generate the mutation as well as sequences 5' of it. The other reaction contains the mutant forward primer and the 3' reverse primer (nt 2991-3020 of SEQ ID NO: 9 in this example), to generate the mutation as well as sequences 3' of it. The two PCR products are then combined in a third reaction using the 5' forward and 3' reverse primers. During annealing, the two different PCR products anneal to each other at their complementary ends comprising the mutation, while the forward and reverse primers bind the outer ends of the same hybrid such that a full-length polynucleotide containing the desired mutation is synthesised and subsequently amplified.

The 3' mouse flanking sequence is also generated by PCR of mouse genomic DNA. The forward primer is derived from nt 898-924 of SEQ ID NO: 11 ([S38219] intron 1 of mouse AGP-3), ie. (5') TCATCGTGGATGAATGCCAAGGTCCTC (3') [SEQ ID NO: 59]. The reverse primer is the reverse complement of nt 3492-3523 of SEQ ID NO: 11 ([S38219], intron 5 of mouse AGP-3), i.e. (5') CAAGGTAGGTAAGCCTGTGGGGCAG CTTGAAG (3') [SEQ ID NO: 60].

Step 3. Assembling the Transgene Vector

The components obtained in steps 1 and 2 are assembled within a plasmid such as pBR322, in the following order; (5'mouse flanking)—(human AGP-1)—(human AGP-2)—(neo)—(3' mouse flanking). The techniques involved are well known to those skilled in the art and include restriction enzyme digestion, ligation and cloning. Unique restriction enzyme recognition sites added to the 5' ends of the primers described above, are useful for facilitating this procedure.

Insertion of a negative selection marker such as HSV-tk at the 5' end of the 5' flanking sequence or the 3' end of the 3' flanking sequence is optional but assists in distinguishing homologous recombinants (which lose the HSV-tk) from random integrants (which maintain the HSV-tk and are thus sensitive to gancyclovir).

Steps 4-6.

As per Example 1.

Example 2C

Obtaining a Knock-In Mouse in which Human AGP Replaces the Endogenous Mouse AGP

Knock-Out Mouse Genes and Insert Human Genes at Same Locus by Homologous Recombination—Procedure 2

Step 1. Obtaining and Assembling the Flanking Mouse Genomic Sequences

The 8.7 kb 5' arm (described in Example 2A, above) is digested with SpeI-XbaI to yield a 5.9 kb fragment that can be cloned into the NheI site of pBR322 or some other vector which contains or lacks the HSV-TK gene. Insertion of a negative selection marker such as HSV-tk at the 5' end of the 5' flanking sequence or the 3' end of the 3' flanking sequence is optional but assists in distinguishing homologous recombinants (which lose the HSV-tk) from random integrants (which maintain the HSV-tk and are thus sensitive to gancyclovir).

The 3' arm (described in Example 2A, above) is cut with XhoI-SalI to yield a 5072 bp fragment that is cloned into the SalI site of pBR322. The total length of homology arms is almost 11 kb. Between these two arms lies a unique SgrAI site that can be used for cloning in the human sequence (see below). Alternatively, artificial primers can be designed and inserted within the SgrA1 site to create a unique NotI site or some other unique RE site(s) for the same purpose.

Step 2. Obtaining and Assembling the Human Genomic Sequences

The 13.5 kb or 16.6 kb human sequence described above is ligated into a pBluescript vector, with a modified multi-cloning site (MCS). Examples of a useful MCS include:

```
SacI---SgrAI---XhoI---NheI---XbaI---SpeI---
BamHI---PstI---SgrAI---KpnI;
or

SacI---SgrAI---NheI---XbaI---SpeI---neo---SgrAI---
KpnI
```

Such MCSs can be generated by hybridising and ligating synthetic primers or by PCR with extended primers containing the appropriate RE sites. SacI and KpnI allow insertion of the MCS into pBluescript. BamHI/PstI allow insertion of the neo gene. SpeI, XbaI and/or NheI allow insertion of the human 6823 bp and 6717 bp XbaI fragments of RP11-82I1 (containing the human AGP genes) described in Example 2A above. For example, the 5' fragment is ligated into NheI/XbaI cut vector and clones with the 5' end at the NheI site identified and cut with XbaI/SpeI, into which the 3' fragment is then ligated. XhoI/SpeI allow insertion of the 16.6 kb human fragment described in Example 2A. For example, the 9821 bp XhoI/SpeI fragment of RP11-82I1 is ligated into the vector cut with the same enzymes. The resultant vector is then cut with SpeI and the 6777 bp SpeI fragment of RP11-82I1 inserted to assemble the complete 16.6 kb human AGP sequence. SgrAI allows removal of the human sequences (with or without neo) and subsequent insertion into the pBR322-based targeting vector described above.

It is also possible to make use of a neo gene that not only has a eukaryotic promoter for G418 resistance in ES cells but also contains a prokaryotic promoter that affords kanamycin resistance in E. coli. When the final ligation step is carried out, selection for both the plasmid conferring ampicillin resistance and for the insert conferring kanamycin resistance will aid in selecting for such a large clone. Other parameters which might aid the construction of a plasmid of close to 30 kb in size is the use of high efficiency electrocompetent cells that support the stable propagation of large plasmids such as DH10B and growing the clones at reduced antibiotic concentration or at lower temperature.

An alternative strategy involves two steps of homologous recombination. For example, the initial targeting vector may comprise the 6.8 kb human fragment containing the human AGP-1 gene. A second round of targeting could then be carried out using a different selectable marker such as hygomycin or puromycin. The 5' arm could be all or part of the 6.8 kb human AGP-1 gene that had been knocked in during the first targeting event and the 3' arm could be the same 3' arm used in the first targeting construct. Between the 5' arm and the antibiotic resistance gene would be inserted the 6.7 kb human AGP-2 fragment. In such a way, the two genes would be knocked in sequentially during two rounds of targeting.

Other alternative cloning strategies include ET cloning (Copeland et al., 2001, *Nature Reviews Genetics* 2: 769-779) or using a cosmid vector or a bacmid vector to facilitate cloning of the larger human sequences.

Step 3. Targeting the Mouse AGP Locus
As per example 1, step 4.

Step 4. Blastocyst Injection
As per Example 1, step 5.

Step 5. Selecting Transgenic Mice
As per Example 1, step 6.

Example 2D

Obtaining a Knock-In Mouse in which Human AGP Replaces the Endogenous Mouse AGP

Knock-Out Mouse Genes and Insert Human Genes at same Locus using Recombinase Technology Step 1. Design of a Targeting Construct to Knockout the Entire Mouse AGP Locus The targeting vector is constructed in a fashion identical to that described in Example 2A, except that the neomycin resistance gene is flanked at one end with a wild-type loxP site and at the other end with a mutant loxP511 site.

Step 2. Obtaining and Assembling the Human Genomic Sequences

The human gene fragment (16.6 kb or 13.5 kb) is cloned into a separate vector as described in Example 2C, except that the two different loxP sites are incorporated into the modified MCS, immediately adjacent to and between the SgrAI sites, such that they flank the human sequence, in the correct orientation. There would be a wild-type loxP recombination site at one end of the fragment and a mutant loxP recombination site (loxP511) at the other end. These two loxP sites cannot recombine together but the loxP511 mutant site can recombine with another loxP511 site.

Step 3. Targeting the Mouse AGP Locus

As per Example 1, using the targeting vector described in step 1 (above) in order to disrupt the mouse AGP locus and insert the loxP sites. Once targeted ES cells are identified, the human fragment can be co-transfected with the Cre recombinase and in a very efficient recombination reaction, the neo gene will be replaced by the human gene via recombination mediated Cre excision (RMCE). In such a way it is possible to efficiently target a single copy of the human gene specifically to the mouse AGP locus, thus controlling both for copy number and for site of integration. No other gene will be disrupted using this technique and the AGP gene will be in its "natural locus" eliminating problems of position effects.

An alternative strategy utilises FLP recombinase rather than Cre recombinase. The procedure is identical to that described above, except that;

in steps 1 and 2, a wild type and a mutant FRT site are substituted for the loxP sites (1998, *Biochemistry* 37(18): 6229-34); and in step 3, a FLP-expression plasmid is substituted for the Cre-expression plasmid.

Example 3

Obtaining a Transgenic Mouse Expressing Human CYP450 Isoforms

A variety of approaches can be used to generate these transgenic mice. Suitably, polynucleotides encoding one or more human CYP isoforms selected from CYP1, CYP2 and CYP3 families are employed. For example, CYP isoforms from the following list are used as components of the transgenes: 1A2, 2A6, 2B6, 2C9, 2C19, 2D6, 2E1, 3A4, 3A5, 4A9, 4A11. Desirably, the transgenic mouse will express CYP3A4 and CYP2D6 and especially it will also express others from this list including CYP2C9 and CYP2C19. This may be achieved by incorporating multiple CYP genes into the same transgenic vector or by the interbreeding of different transgenic mice, each containing a different human CYP isoform in order to generate double, triple quadruple etc. transgenics. Such transgenics may be produced by random integration of the transgene or homologous integration into a specific site and may or may not be associated with disruption of an endogenous mouse CYP isoform.

Step 1. Obtaining a polynucleotide Encoding CYP3A4.

The preferred technique involves obtaining a BAC or YAC clone, containing human CYP3A4 and either using the clone directly or linearising it prior to embryo injection. This technique has the advantage that multiple CYP3A genes located within the same vector are simultaneously introduced. Clones RP11-316A24 and RP11-757A13 (Genome Sequencing Center, Washington, U.S.A.) are suitable clones. Other appropriate BAC or YAC clones are obtained by screening human genomic libraries using probes designed from SEQ ID NO: 23 relating to BAC clone RP11-757A13 (GenBank Accession No. AC069294). Reference also may be made to the sequence set forth in GenBank Accession No. AF209389, which defines a 26502 nt polynucleotide comprising exons 1 through 13 of the human CYP3A4 gene. AQ539660 and AQ539659 define the BAC ends of RP11-316A24 and NG_000004 defines the relevant contig.

An alternative strategy involves synthesizing the following primers and where appropriate, also including restriction enzyme recognition sites at the 5' ends:

Primer 1—(5') GTCCAAACACTTCTCTATGATAATG-CAAACAGTCAC (3') [SEQ ID NO: 61] i.e. nt 26930-26965 of SEQ ID NO: 23 (AC069294), which is ~8.4 kb upstream of START codon;

Primer 2—(5') GTTGCTCTTTGCTGGGCTATGTG-CATGG (3') [SEQ ID NO: 62] ie. the reverse complement of nt 35227-35254 of SEQ ID NO: 23 (AC069294) and nt 26-53 of SEQ ID NO: 24 relating to GenBank Accession No. NM_017460, which is within 5'-UTR of CYP3A4;

Primer 3—(5') ACAGAGCTGAAAGGAAGACTCA-GAGGA (3') [SEQ ID NO: 63] i.e. nt 35255-35281 of SEQ ID NO: 23 (AC069294) and nt 54-80 of SEQ ID NO: 24 (NM_017460), which is within 5'-UTR; immediately downstream of Primer 2 locus; and Primer 4—(5') GACCAATCGACTGTTTTTTAT-TAAGTG (3') [SEQ ID NO: 64] i.e. reverse complement of nt 62380-62406 of SEQ ID NO: 23 (AC069294) and nt 2738-2764 of SEQ ID NO: 24 (NM_017460), which is within 3'-UTR and including poly-adenylation site. Alternatively, an oligo-dT primer, which binds poly A tails, can be used in place of primer 4.

The following PCR reactions are then performed:

PCR Reaction A; Long range PCR is performed using Primers 1 and 2, with BAC clone RP11-757A13 or human genomic DNA as the template. The product corresponds to ~8.4 kb of 5' flanking sequence (including the human CYP3A4 promoter and enhancers) as well as part of the 5'-UTR.

PCR Reaction B; PCR using Primer 3 and Primer 4, with human liver cDNA as the template. The product corresponds to the entire protein coding sequence as well as the 3'-UTR (including polyadenylation signal) and the portion of the 5'-UTR not amplified in Reaction A.

Step 2. Assembling the Transgene Vector

The two PCR products are assembled in a suitable vector such as pBluescript (Stratagene). The inclusion of appropriate restriction enzyme sites at the 5' end of the primers facilitates this process.

In the case of using a BAC or YAC clone, no assemblage is required.

Step 3. Inserting the Transgene into Mouse Embryos

The BAC clone is purified directly, or linearised and then purified. The PCR-generated constructs are cut from the plasmid vector and isolated from the plasmid DNA. The purified transgene is then microinjected into the male pronucleus of isolated mouse embryos, which are then implanted into the oviduct of pseudopregnant surrogate host mice according to standard techniques for generating transgenic mice by random integration. Additional details are given elsewhere in this document. Alternatively, the transgene DNA is transfected into ES cells (with or without a co-transfected selection marker such as neo). Clones are screened for integration and copy number by Southern blot and/or PCR.

Step 4. Selecting Transgenic Mice

Transgenic mice are identified by PCR and/or Southern blotting and expression of the transgene is confirmed by Western blotting, ELISA or other immunological assays using appropriate tissue samples, such as liver. Alternatively liver RNA is analysed by Northern blotting.

In another strategy, homologous recombination of the transgene is used to insert a single copy of the transgene at a desired site in the mouse genome. Preferably, that site is near to or at the site of an endogenous mouse CYP gene similar to the human transgene. For example, mouse CYP3A11, 3A13, CYP3A25 or 3A16, when the human transgene is also a member of the CYP3A family, such as CYP3A4. Flanking mouse sequences are incorporated into the transgene construct as described in Examples 1 and 2, in order to achieve homologous recombination. These flanking sequences are, for example, derived from mouse genomic sequences within or flanking the mouse CYP gene, in the case where it is preferable to disrupt expression of the mouse protein. In the case of transgenic mice generated by microinjection of BAC or YAC clones, disruption of mouse CYP isoforms is performed in separate mice, which are subsequently bred with the human CYP-expressing mice described above. A similar technique has been used to generate mice expressing human-like but not mouse-like imnmunoglobulins (Green L L. 1999, *J. Immunol. Methods* 231: 11-23).

The mouse homologues to the human CYP3A genes are located on chromosome 5. On this chromosome, there are several CYP3A genes

| a) CP3G | CYP3A16 (ensembl ID: ENSMUSG00000029628) |
| b) CP3B | CYP3A11 (ensembl ID: ENSMUSG00000029630) |
| c) CP3P | CYP3A25 (ensembl ID: ENSMUSG00000029631) |
| d) CP3D | CYP3A13 (ensembl ID ENSMUSG00000029727) |

The order is CYP3A13-~8 Mb-CYP3A16-~300 kb-CYP3A-~400 kb-CYP3A25.

It is possible to knockout each gene individually. It is also possible that in the case of 16, 11 and 25, to carry out two targeting events to target a wild-type loxP site to the 5' flanking region and to target a mutant loxP511 to the 3' flanking. Then one could take a human BAC, such as RP11-316A24, which contains the wt and mutant loxP site at either end and target it to this chromosomal region (with Cre recombinase), thus deleting all three mouse genes and inserting human CYP3A4, 3A5, 3A7 and 3A3, which are contained within this BAC.

Example 4

Obtaining a Transgenic Mouse Expressing Human UGT (UDPGT) Isoforms

The UGT gene family includes UGT1 and UGT2 subtypes. In humans, 9 UGT1 genes are known (plus 4 pseudogenes), all of which map to the same locus at 7q22 (Gong et al., 2001; *Pharmacogenetics* 11: 357-368). Each of these genes utilises a unique promoter and exon 1, which encodes substrate specificity, whereas all of these genes share the same exons 2-5, which encode an identical carboxyl terminus required for interactions with UDP-glucuronic acid.

In the mouse, there are at least 3 genes of the UGT1 family that map to mouse chromosome 1. They are: UD16, UD12 and UD17 which span 86.17 kb, 16.65 kb and 5.19 kb of genomic DNA respectively. It is possible that other genes also lie in this region (including UD11). Each gene has a different promoter and exon 1 but they all share the last three exons. These mouse UGT genes have been mapped to a 75 kb contig set forth in SEQ ID NO: 65. The last three exons all map to a 5 kb region.

The position of various exons of each gene on the 75 kb contig are as follows:

|        | UD17       |             |        | UD12       |             |
|--------|------------|-------------|--------|------------|-------------|
| Exon 1 | 1-928      | 34926-34000 | Exon 1 | 1-952      | 46298-45347 |
| Exon 2 | 928-1083   | 31201-31044 | Exon 2 | 953-1104   | 31201-31044 |
| Exon 3 | 1081-1300  | 30788-30568 | Exon 3 | 1105-1323  | 30788-30568 |
| Exon 4 | 1300-1593  | 28800-28504 | Exon 4 | 1324-1617  | 28800-28504 |

| UD16 | | |
|---|---|---|
| Exon 1-3 | out of contig range | |
| Exon 4 | 853-922 | 34128-34059 |
| Exon 5 | 921-1077 | 31201-31044 |
| Exon 6 | 1078-1295 | 30788-30568 |
| Exon 7 | 1294-1587 | 28800-28504 |

An additional gene also lies on this contig

| DNAjb3 | | |
|---|---|---|
| Exon | 1-1014 | 41187-42200 |

Upon homologous recombination, the targeting construct described below will delete the last three exons of these genes (and will also delete exon 1 of UD17 and exon 4 of UD16). Stop codons are inserted in all three reading frames to ensure that the genes are not expressed. The 3' arm can be amplified using mouse genomic DNA and the following primers:

```
ugt23275F
                                     [SEQ ID NO: 66]
(5') GAAGTCGACGTTTCAGAGTCATACCAAAAGG (3')
(from nt 23275 to nt 23296 in SEQ ID NO: 65);
and ugt27501R
                                     [SEQ ID NO: 67]
(5') GAAGTCGACATCTTACACAGGTCCCAAAGC (3')
(from nt 27501 to nt 27481 in SEQ ID NO: 65)
```

These have artificial SalI sites at the ends. The PCR fragment is digested with SalI and cloned into the SalI site of the targeting vector (pBluescript with neo gene as described in previous examples).

The 5' arm can be amplified using mouse genomic DNA and the following primers:

```
ugt35967R
                                     [SEQ ID NO: 68]
(5') CTAAGAATGAGCAAAGTGTCC (3')
(from nt 35967 to nt 35947 in SEQ ID NO: 65);
and ugt31170F
                                     [SEQ ID NO: 69]
(5') GCAATACTAGCTAGAAAGGCCAG (3')
(from nt 31170 to nt 31193 in SEQ ID NO: 65)
```

The PCR fragment is cloned into the pGEMTeasy vector, digested with NotI and cloned into the NotI site at the 3' end of the neo gene. The neo gene will be transcribed in the opposite direction of the UGT. The 3' end of this arm contains the first 7-bp of the third last exon (in the case of UD12 and UD17, exon 3). The neomycin resistance gene will contain stop codons in all three (antisense) frames for inducing nonsense-mediated decay of the truncated mouse UGT mRNA and terminating the translation of any possible mutant UGT protein. It is also possible to engineer into the targeting vector a fragment containing RNA destabilising elements to further ensure that any truncated mouse UGT mRNA is degraded rapidly.

The targeting vector will be electroporated into ES cells as described in Example 6 and ES cell clones in which the region has been correctly targeted will be picked according to Example 7 and identified by Southern blot of G418-resistant clones. The targeted ES cells are then transfected with human BAC clone RP11-943B10, available from Children's Hospital Oakland Research Institute (CHORI); (BAC ends identified as AQ564938 and AQ711093; Locus defined in AF297093). The BAC may be co-transfected with a plasmid conferring hygromycin or puromycin resistance to assist selection of positive clones. Selected clones are then expanded and screened for copy number and site of integration as mentioned above. This BAC contains the following human UGT1 genes: UGT1A1, UGT1A2p, UGT1A3, UGT1A4, UGT1A5, UGT1A6, UGT1A7, UGT1A9, UGT1A10, UGT1A13p (p indicates a pseudogene).

An alternative approach involves using a targeting vector that has the neomycin resistance gene flanked by a wildtype loxP site and a mutant loxP site (loxP511). Cells targeted with this vector can be transfected with the BAC, which has the wild type and mutant loxP sites in its vector backbone together with the a plasmid expressing the CRE recombinase. Colonies that have undergone recombination-mediated Cre excision (RMCE) are selected. In such clones, the neo gene (at the mouse UGT locus) is replaced by the human UGT genes. Alternatively, a wildtype and a mutant FRT site can be used in conjunction with the FLP recombinase.

Example 5

Obtaining a Transgenic Mouse Expressing Human MDR-1

The human MDR-1 gene encodes a large transmembrane protein (P-glycoprotein or P-gp) expressed in a variety of tissues including liver, kidney and intestinal epithelium. P-gp is an integral part of the blood-brain barrier and functions as a drug-transport pump transporting a variety of drugs from the brain back into the blood. Indeed, the MDR-1 P-glycoprotein extrudes a variety of drugs across the plasma membrane of many cell types.

Whereas humans have only one MDR-1 gene, mice have two. MDR-1a is highly expressed in the intestinal epithelium, where it actively excretes xenobiotics absorbed from the intestinal lumen and at the blood-brain barrier, where it protects the brain from xenobiotics in the blood. MDR-1b is highly expressed in the adrenal gland, pregnant uterus and ovaries. Both mouse genes are substantially expressed in many other tissues.

Naturally occurring MDR-1a mutant mice (of the CF-1 outbred mouse strain) that lack the MDR-1a P-glycoproteinhave been described (Umbenhauer et al., 1997, *Toxicol. Appl. Pharmacol.* 146(1): 88-94). Knock-out mice have also been generated for each mouse mdr1 gene alone and in combination (Shinkel et al., 1997; *Proc. Natl. Acad. Sci USA* 94: 4028-4033). Transgenic mice expressing human MDR-1 can therefore be bred with any of the above-mentioned mice to generate mice that express the human but not mouse forms of these genes.

The following example describes a method for constructing transgenic mice expressing human MDR-1. The human MR-1 cDNA (GenBank Accession No. NM_000927) [SEQ ID NO: 70] is obtained by RT-PCR of human liver mRNA and assembled in a vector together with human 5' and (preferably) 3' flanking regulatory sequences and a selectable marker gene. Flanking sequences are obtained by PCR of human genomic DNA or BAC Clone CTB60P12 (GenBank Accession No. AC002457) for the 5' flank and BAC Clone CTB137N13 (GenBank Accession No. AC005068) for the 3' flank, each of which is obtainable from CalTech human BAC library B. The assembled transgene is then introduced by random integration as described in Example 6 and previous examples.

The following primers are useful for this purpose. Enzyme sites added to the 5' ends are indicated and should be flanked by sufficient nucleotides to permit efficient digestion:

Primer MDR1 (forward) (5') SalI-GAAACCCTAG-GCACTAAATCCC (3') [SEQ ID NO: 71] which overlaps AvrII site in promoter; nt 4930-4951 in 5' flank human MDR contig set forth in SEQ ID NO: 72.

Primer MDR2 (reverse) (5') ClaI-GGGATTTAGTGC-CTAGGGTTTC (3') [SEQ ID NO: 73], which overlaps AvrII site in promoter; reverse complement of nt 4930-4951 of 5' flank human MDR contig [SEQ ID NO: 72].

Primer MDR3 (forward) (5') CTCATTCTCCTAGGAG-TACTCAC (3') [SEQ ID NO: 74], which overlaps AvrII site in exon 1; nt 10049-10071 of 5' flank MDR contig [SEQ ID NO: 72] and nt 56-72 of MDR-1 cDNA [SEQ ID NO: 70].

Primer MDR4 (reverse) (5') GTGAGTACTCCTAG-GAGAATGAG (3') [SEQ ID NO: 75], which overlaps AvrII site in exon 1; reverse complement of nt 10049-10071 of 5' flank MDR contig set forth in SEQ ID NO: 72 and nt 56-72 of MDR-1 cDNA [SEQ ID NO: 70]

Primer MDR5 (forward) (5') SalI-AAAGCTTGCAGTG-TAAGATGCG (3') [SEQ ID NO: 76]; nt 292-313 of 5' flank MDR contig [SEQ ID NO: 72].

Primer MDR6 (reverse) (5') ClaI-CACATGAAAGTT-TAGTTTTATTATAGAC AC (3') [SEQ ID NO: 77]; reverse complement of nt 4614-4643 of MDR-1 cDNA [SEQ ID NO: 70] (in 3'UTR, downstream of PmeI site).

Primer MDR7 (reverse) (5') XbaI-TGGTCAACAGAG-CAAGACTCCGCTTC (3') [SEQ ID NO: 78], which is located ~1730 bp downstream of the MDR1 polyadenylation signal; nt 36075-36100 of GenBank Accession No. AC005068 (BAC Clone CTB137N13, which is obtainable from CalTech human BAC library B) . A 1940 nt sequence corresponding to reverse complement of nt 36061-38001 of GenBank Accession No. AC005068 is presented in SEQ ID NO: 79. Primer MDR7 is the reverse complement of nt 1900-1926 in this sequence.

Primer MDR8 (forward) (5') GCGCCAGTGAACTCT-GACTGTATGAGATG (3') [SEQ ID NO: 80]; nt 4255-4283 of human MDR-1 cDNA [SEQ ID NO: 70], which is located in 3'UTR upstream of the PmeI site.

Obtaining Human 5' Flank with Promoter Elements

PCR Reaction 1: Production of a SalI-ClaI Fragment Extending from ~5kb to 10 kb Upstream of Transcription Start Site.

PCR is performed with primers MDR5 and MDR2, using as a template, human genomic DNA or more preferably, DNA from a BAC clone such as CTB-60P12 (obtainable from CalTech human BAC library B; GenBank accession number AC002457), which contains the appropriate sequence.

PCR Reaction 2: Production of an AvrII Fragment Extending from Within Exon 1 to ~5 kb Upstream of Transcription Start Site.

PCR is performed with primers MDR1 and MDR4, using as a template, human genomic DNA or more preferably, DNA from a BAC clone such as CTB-60P12 (obtainable from CalTech human BAC library B; GenBank accession number AC002457), which contains the appropriate sequence.

Obtaining Human MDR-1 Coding Sequences

PCR Reaction 3: Production of an AvrII-ClaI Fragment Containing the Human cDNA from within the 5'UTR to within the 3'UTR.

Human MDR-1 cDNA (GenBank Accession No. NM_000927) is obtained by RT-PCR of human liver mRNA, using primers MDR3 and MDR6

Obtaining Human 3' Flank

PCR Reaction 4: Production of a PmeI-XbaI Fragment Extending from the Last Exon to ~1.7 kb Downstream of the Polyadenylation Signal.

PCR is performed with primers MDR7 and MDR8, using as a template, human genomic DNA or more preferably, DNA from a BAC clone such as CTB-137N13 (obtainable from CalTech human BAC library B; GenBank accession number AC005068), which contains the appropriate sequence.

Assembling Vector

Step 1: The neomycin resistance gene is ligated into an appropriate site (e.g. SacII) in a pBluescript vector.

Step 2: The PCR product from Reaction 1 is digested with SalI/ClaI and ligated into a the SaI/ClaI sites of the vector from Step 1 (thus also inserting an AvrII site close to and upstream of the [ClaI] site).

Step3: The PCR product from Reaction 3 is digested with AvrII/ClaI and ligated into the AvrII/ClaI sites of the vector from Step 2 (thus also inserting a PmeI site close to and upstream of the [ClaI] site).

Step4: The PCR product from Reaction 2 is digested with AvrII and ligated into the AvrII site of the vector from Step 3.

Step 5: The PCR product from Reaction 4 is digested with PmeI/XbaI and ligated into the PmeI/XbaI sites of the vector from Step 4.

Generating Mice

The construct is linearised with NotI and transfected into ES cells for random integration (see Example 6). Alternatively the transgene can be removed from the vector backbone by digestion with BssHII or SalI/XbaI prior to transfection. Clones are selected in G418 and analysed by Southern blot to determine copy number. Suitable clones (preferably a single gene copy) are implanted into blastocysts as described in previous examples and the resultant chimeras bred to generate homozygous mice expressing human MDR-1. Such mice can be cross-bred with mdr1a/1b double knock-out mice (Schinkel et al., 1997; *Proc. Natl. Acad. Sci. USA* 94: 4028-4033), which are available from Taconic, Germantown, N.Y., USA. The resultant triple-transgenic mice will lack expression of both mouse MDR-1 genes but express the homologous human MDR-1 gene.

Example 6

Electroporation of ES Cells

Prior to electroporation day the following should be prepared:
(i) 12×10 cm plates and 4×6 cm plates containing a feeder layer of mitotically inactivated neomycin resistant fibroblasts (or hygromycin- or puromycin-resistant fibroblasts as appropriate.
(ii) ES cells should be grown to approximately 80% confluency such that at least $3\times10^7$ cells are available on day of electroporation.
1. Change media on the ES cells 2-4 hrs before cells will be harvested. Usually 3×10 cm plates of ES cells will be available. This will provide at least $4\times10^7$ cells. This is more than adequate since $2\times10^7$ cells are required for one electroporation.
2. Harvest cells as described previously using 0.25% trypsin/EDTA and incubating for 5 min at 37° C.
3. Collect cells into a 50 mL tube. Wash cells with EB media.
4. Resuspend pellet in 10 mL of Electroporation Buffer (EB; 1× Hanks solution (Gibco-BRL), 20 mM Hepes, 28 mM 2-beta mercaptoethanol, 1 mM NaOH).
5. Determine viable cell density using trypan blue exclusion.
6. Spin cells 1500 rpm for 5 min.
7. Resuspend cells in EB such that cell density is approximately $3\times10^7$ cells/mL.
8. Label two, 0.4 cm electroporation cuvettes: (i) "+DNA" and add $2\times10^7$ cells and 33 μg DNA in a final volume of 800 μL. (ii)-"DNA control" and add $1.1\times10^6$ cells in a final volume of 800 μL
9. Allow to stand at room temperature for 10 min.
10. Mix up and down gently with a sterile transfer pipette.
11. Electroporate with gene pulsar with settings at 0.4 Kvolts, 25μFD (time constant should be 0.4 or 0.5 sec).
12. Allow to stand for 10 min at room temperature.
13. Plate out cells from +DNA cuvette onto 12×10 cm plates, along with the proportionate amount of cells onto the 2×6 cm control plates.
14. Plate out cells from—DNA cuvette onto 2× cm plates.
15. Begin selection with geneticin (G418) alone or with the addition of ganciclovir 24 hours later.
16. For double selection usually use a concentration of 300 μg/mL for G418 and 2 μM for ganciclovir.
17. Change media daily.
18. Pick surviving clones on day 10 or 11.

Example 7

Picking Colonies

Materials:
Dissecting microscope, mouth pipette, multi-channel pipette, 96 well U-bottom plates
Day before picking prepare 15 or 30, 24 well plates with mitotically inactivated neomycin resistant embryonic fibroblasts. These cells are set up in ES cell growth media so that they are ready to be used the following day.

Preparation:
Using a multichannel pipette add 30 μL of 0.25% trypsin-EDTA to 96 well U-bottom plates. Set up enough plates for the number of cells to be picked i.e. 4×96 well plates when picking 360 colonies or 8×96 well plates when picking 720 colonies.
Add Hanks/Hepes buffer to 2 wells of a 6 well plate, this can be used for washing the picking pipette in between colonies. Add 0.25% trypsin/EDTA to one well of the 6 well plate, a small volume of this is collected into the picking pipette so that the colony can be maintained in trypsin.

Procedure:
1. Wash 2 or 3 of the 10 cm plates that contain the colonies to be picked with 5-10 mL of Hanks/Hepes buffer (H/H).
2. Add 5 ml H/H and leave on plate.
3. Wash pulled pasteur pipette a number of times with 70% ethanol.
4. Wash repeatedly with H/H and then collect a small volume of trypsin solution with picking pipette.
5. Using the dissecting microscope, which is set up in a Laminar flow cabinet, identify the colony that you want to pick.
6. Gently cut around the feeder cell layer with the pickling pipette. Aspirate the ES cell colony into the pipette by mouth suction and transfer the colony to one of wells of a 96 well plate containing the trypsin solution.
7. Collect 24 colonies (ie. 3 rows of a 96 well plate).
8. Transfer the 96 well plate to the 37° C. incubator for 5 mins to encourage the cells to disperse.
9. Using a multichannel pipette disperse the colony by agitating vigorously 2-3 times.
10. Add 50 μL of media from the 24 well plate into the 96 well plate and again disperse vigorously.
11. Transfer all cells to 24 well plate, keeping each individual colony separate.
12. Continue until all 24 well plates have ES cells in them.
13. Change media the following day.

Example 8

Construction of the pBluescript Neo tk Vector

The pBluescript neo tk vector was constructed as follows. The neomycin resistance gene has a tk promoter and was excised from pMC1neo (GenBank Acc. No. U43612) with SalI and XhoI and inserted into the SmaI site of pBluescript II KS. The thymidine kinase gene is derived from Herpes Simples Virus (HSV) and has been engineered for expression in ES cells (GenBank Acc. No. AF090451). It is flanked by a duplication of a mutant polyoma virus enhancer. The thymidine kinase gene was excised from pIC19R/MC1-tk with XhoI and HindIII and cloned into the ApaI site of the pBluescript neo vector. Both the neo and tk genes and the T3 promoter of pBluescript are transcribed in the same direction.

The disclosure of every patent, patent application, and publication cited herein is hereby incorporated herein by reference in its entirety.

The citation of any reference herein should not be construed as an admission that such reference is available as "Prior Art" to the instant application.

Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

TABLE 1

Common metabolic reactions involved in the biotransformation of drugs
Biotransformation reaction Oxidative reactions Dealkylation (O- or N-linked)
Deamination
Desulphuration
Hydroxylation (aliphatic or aromatic side chains)
Hydroxylation (N-linked)
Sulphoxide derivativisation
Conjugation reactions Acetylation
Glucuronidation TABLE 1-continued Common metabolic reactions involved in the biotransformation of drugs
Biotransformation reaction Glycine conjugation
Methylation (O-, N-, or S-linked)
Sulphate conjugation
Hydrolytic reactions Hydrolysis of esters or amides
Reductive metabolism Azo groups
Nitro groups Adapted from (Gilman et al., 1985, supra)

SEQUENCE LISTING (80 sequences)

SEQ ID NO: 1 - DNA, 19002 bp, Homo sapiens
  mRNA (1737)...(1854): Exon 1
  intron (1855)...(2563): Intron 1
  mRNA (2564)...(2621): Exon 2
  intron (2622)...(4075): Intron 2
  mRNA (4076)...(4208): Exon 3
  intron (4209)...(6040): Intron 3
  mRNA (6041)...(6252): Exon 4
  intron (6253)...(6801): Intron 4
  mRNA (6802)...(6934): Exon 5
  intron (6935)...(7758): Intron 5
  mRNA (7759)...(7856): Exon 6
  intron (7858)...(9443): Intron 6
  mRNA (9444)...(9573): Exon 7
  intron (9574)...(10866): Intron 7
  mRNA (10867)...(11081): Exon 8
  intron (11082)...(12480): Intron 8
  mRNA (12481)...(12613): Exon 9
  intron (12614)...(13701): Intron 9
  mRNA (13702)...(13799): Exon 10
  intron (13800)...(14976): Intron 10
  mRNA (14977)...(15115): Exon 11
  intron (15116)...(15533): Intron 11
  mRNA (15534)...(15757): Exon 12
  intron (15758)...(16940): Intron 12
  mRNA (16941)...(17073): Exon 13
  intron (17074)...(17687): Intron 13
  mRNA (17688)...(17755): Exon 14
  CDS (1776)...(1854)
  CDS (2564)...(2621)
  CDS (4076)...(4208)
  CDS (6041)...(6252)
  CDS (6802)...(6934)
  CDS (7759)...(7856)
  CDS (9444)...(9573)
  CDS (10867)...(11081)
  CDS (12481)...(12613)
  CDS (13702)...(13799)
  CDS (14977)...(15115)
  CDS (15534)...(15757)
  CDS (16941)...(17073)
  CDS (17688)...(17729)
  sig_peptide (1776)...(1829)
  mat_peptide (1848)...(0)
cctttcccagggacttctacaaggaaaaagctagagttggttactgacttctaataaataatgcctacaatttctaggaagttaaaagttgacataatttatccaagaaagaattattttcttaacttagaatagtttcttttttcttttcagatgtaggtttttctggctttagaaaaaatgcttgtttttcttcaatggaaaataggcacacttgttttatgtctgttcatctgtagtcagaaagacaagtctggtatttcctttcaggactcccttgagtcattaaaaaaaatcttcctatctatctatgtatctatcatccatctagctttgattttttcctcttctgtgctttattagttaattagtacccatttctgaagaagaaataacataagattatagaaaataatttctttcattgtaagactgaatagaaaaaattttctttcattataagactgagtagaaaaaataatactttgttagtctctgtgcctctatgtgccatgaggaaatttgactactggttttgactgactgagttatttaattaagtaaaataactggcttagtactaattattgttctgtagtatcagagaaagttgttcttcctactggttgagctcagtagttcttcatattctgagcaaaagggcagaggtaggatagcttttctgaggtagagataagaaccttgggtagggaaggaagatttatgaaatatttaaaaaattattcttccttcgctttgtttttagacataatgttaaatttattttgaaatttaaagcaacataaaagaacatgtgatttttctacttattgaaagagagaaaggaaaaaaatatgaaacagggatggaaagaatcctatgcctggtgaaggtcaagggttctcataacctacagagaatttggggtcagcctgtcctattgtatattatggcaaagataatcatcatctcatttgggtccattttcctctccatctctgcttaactgaagatcccatgagatatactcacactgaatctaaatagcctatctcagggcttgaatcacatgtgggccacagcaggaatgggaacatggaatttctaagtcctatcttacttgttattgttgctatgtctttttcttagtttgcatctgaggcaacatcagctttttcagacagaatggctttggaatagtaaaaaagacacagaagccctaaaatatgtatgtatgtatatgtgtgtgtgcatgcgtgagtacttgtgtgtaaatttttcattatctataggtaaaagcacacttggaattagcaatagatgcaatttgggacttaactctttcagtatgtcttatttctaagcaaagtatttagtttggttagtaattactaaacactgagaactaaattgcaaacaccaagaactaaaatgttcaagtgggaaattacagttaaataccatggtaatgaataaaaggtacaaatcgtttaaactcttatgtaaaatttgataagatgttttacacaactttaatacattgacaaggtcttgtggagaaaacagttccagatggtaaatatacacaagggatttagtcaaacaattttttggcaagaatattatgaattttgtaatcggttggcagccaatgaaatacaaagatgagtctagttaataatctacaattattggttaaagaagtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacgtaagaaatccatttttctattgttcaacttttattctattttcccagtaaaataaagttttagtaaactctgcatctttaaagaattattttggcatttatttctaaaatggcatagtattttgtatttgtgaagtcttacaaggttatcttattaataaaattcaaacatcctaggtaaaaaaaaaaaaaggtcagaattgtttagtgactgtaattttcttttgcgcactaaggaaagtgcaaagtaacttagagtgactgaaacttcacagaatagggttgaagattgaattcataactatcccaaagacctatccattgcactatgctttatttaaaaaccacaaaacctgtgctgttgatctcataaatagaacttgtatttatatttattttcattttagtctgtcttcttggttgctgttgatagacactaaaagagtattagatattatctaagtttgaatataaggctataaatatttaataatttttaaaatagtattcttggtaattgaattattcttctgtttaaaggcagaagaaataattgaacatcatcctgagtttttctgtaggaatcagagcccaatattttgaaacaaatgcataatctaagtcaaatggaaagaaatataaaaagtaacattattacttcttgttttcttcagtatttaacaatccttttttttcttcccttgcccagacaagagtgaggttgctcatcggtttaaagatttgggagaagaaaatttcaaagccttgtaagttaaaatattgatgaatcaaatttaatgtttctaatagtgttgtttattattctaaagtgcttatatttccttgtcatcagggttcagattctaaaacagtgctgcctcgtagagttttctgcgttgaggaagatattctgtatctgggctatccaataaggtagtcactggtcacatggctattgagtacttcaaatatgacaagtgcaactgagaaacaaaaacttaaattgtatttaattgtagttaatttgaatgtatatagtcacatgtggctaatggctactgtattggacagtacagctctggaacttgcttggtggaaaggactttaatataggtttcctttggtggcttacccactaaatcttctttacatagcaagcattcctgtgcttagttgggaatatttaatttttttttttttttaagacagggtctcgctctgtcgcccaggctggagtgcagtggcgcaatctcggctcactgcaaactccgctcccgggttcacgccattctcctgcctcagcctcccgagtagctgggactacaggcgcccgccatcacgcccggctaatcttttgtatttttagtagagatggggtttcaccgtgtgccaggatggtctcaatctcctgacatcgtgatctgcccacctcggcctcccaaagtgctgggattacaggagtgagtcaccgcgcccggcctatttaaatgttttttaatctagtaaaaaatgagaaaattgtttttttaaaagtctacctaatcctacaggctaattaaagacgtgtgtggggatcaggtgcggtggttcacacctgtaatcccagcactttggaaggctgatgcaggaggattgcttgagcccaggagtacaagaccagcctgggcaagtctctttaaaaaaaacaaaacaaacaaacaaaaaaattaggcatggtggcacatgcctgtagtcctagctacttaggaggctgacgtaggaggatcgtttggacctgagaggtcaaggctacagtgagccatgattgtgccactgcactccagcctgggtgacagagtgagactctgtctcaaaaaagaaaaaggaaatctgtggggtttgttttagttttaagtaattctaaggactttaaaaatgcctagtcttgacaattagatctatttggcatacaatttgcttgcttaatctatgtgtgtgcatagatctactgacacacgcatacatataaacattagggaactaccattctctttgcgtaggaagccacatatgcctatctaggcctcagatcatacctgatatgaataggctttctggataatggtgaagaagatgtataaaagatagaacctatacccatacatgatttgttctctagcgtagcaacctgttacatattaaagttttattatactacatttttctacatcctttgtttcagggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttgtaagtacattctaattgtggagattctttcttctgtttgaagtaatcccaagcatttcaaaggaattttttttaagttttctcaattattattaagtgtcctgatttgtaagaaacactaaaaagttgctcatagactgataagccattgtttcttttgtgatagagatgctttagctatgtccacagttttaaaatcatttctttattgagaccaaacacaacagtcatggtgtatttaaatggcaatttgtcatttataaacacctctttttaaaatttgaggtttggtttctttttgtagaggctaatagggatatgatagcatgtatttatttatttatttatcttattttattatagtaagaacccttaacatgagatctaccctgttatatttttaagtgtacaatccattattgttaactacgggtacactgttgtatagcttactcatcttgctgtattaaaactttgtgcccattgattagtaacccctcgtttcgtcctcccccagccactggcaaccagcattatactctttgattctatgagtttgactactttagctaccttatataagtggtattatgtactgtttatctttttatgactgacttatttcccttagcatagtgcattcaaagtccaaccatgttgttgcctattgcagaatttccttcttttcaaggctgaataatattccagtgcatgtgtgtaccacattttctttatccattaatttgttgattgatagacatttaggttggttttctacatcttgactatcatgaatagtgttgcaatgaacacaggagagctactatctcttagagatgatatcatggtttttatcatcagaaaacacccactgatttctatgctaattttgttacctgggtggaataatagtacagctatatattcctcattttagatatctttgtatttctacatacaataaaaaagcagagtacttagtcatgttgaagaactttaaacttttagtatttccagatcaatcttcaaaacaaggacaggtttatctttctctcaccactcaatctatatatacctcttgtgggcaaggccagtttttatcactggagcctttcccctttttattatgtacctctccctcacagcagagtcaggactttaactttacacaatactatggctctacatatgaaatcttaaaaatacataaaaattaataaattctgtctagagtagtatattttccctggggttacgattactttcataataaaaattagagataaggaaaggactcatttattggaaagtgattttaggtaacatttctggaagaaaaatgtctatatcttaatagtcacttaatatatgatggattgtgttactcctcagttttcaatggcatatactaaaacatggccctctaaaaagggggcaaatgaaatgagaaactctctgaatgtttttctcccctaggtgaattcacctgctgcttagaagcttattttctcttgatttctgttataatgattgctcttaccctttagttttaagtttcaaaataggagtcatataactttccttaaagctattgactgtctttttgtcctgttttattcaccatgagttatagtgtgacagttaattcttatgaaaattatatagagatggttaaatcatcagaaactgtaaacctcgattgggaggggaagcggatttttaaatgatttcctgaccaagcttaaccagtatattaaatcctttgtactgttctttggctataaagaaaaaaggtactgtccagcaactgaaacctgctttcttccatttagcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaagtaagtaatcagatgtttatagttcaaaattaaaaagcatggagtaactccataggccaacactctataaaaattaccataacaaaaatattttcaacattaagacttggaagttttgttatgatgattttttaaagaagtagtatttgataccacaaaattctacacagcaaaaaatatgatcaaagatattttgaagtttattgaaacaggatacaatctttctgaaaaatttaagatagacaaattatttaatgtattacgaagatatgtatatatggttgttataattgatttcgttttagtcagcaacattatattgccaaaatttaaccatttatgcacacacacacacacacacacacacttaacccttttttccacatacttaaagaatgacagagacaagaccatcatgtgcaaattgagcttaattggttaattagatatctttggaatttggaggttctggggagaatgtcgattacaattatttctgtaatattgtctgctatagaaaagtgactgtttttctttttcaaaatttagatacttatatgaaattgccagaagacatccttacttttatgccccggaactccttttctttgctaaaaggtataaagctgcttttacagaatgttgccaagctgctgataaagctgcctgcctgttgccaaaggtattatgcaaaagaatagaaaaaaagagttcattatccaacctgattttgtccattttgtggctagatttagggaacctgagtgtctgatacaaactttccgacatggtcaaaaaagccttccttttatctgtcttgaaaatctttcatctttgaaggcctacactctcgtttcttcttttaagatttgccaatgatgatctgtcagaggtaatcactgtgcatgtgtttaaagatttcaccactttttatggtggtgatcactatagtgaaatactgaaacttgtttgtcaaattgcacagcaaggggacacagttcttgtttatcttttcatgataatttttagtagggagggaattcaaagtagagaattttactgcatctagatgcctgagttcatgcattcattccataaatatatattatggaatgctttattttcttttctgaggagtttactgatgttggtggaggagagactgaaatgaattatacacaaaatttaaaaattagcaaaattgcagcccctgggatattagcgtactctttctctgacttttctcccacttttaaggctctttttcctggcaatgtttccagttggtttctaactacatagggaattccgctgtgaccagaatgatcgaatgatctttccttttcttagagagcaaaatcattattcgctaaagggagtacttgggaatttaggcataaattatgccttcaaaatttaatttggcacagtctcatctgagcttatggaggggtgtttcatgtagaatttttcttctaattttcatcaaattattcctttttgtagctcgatgaacttcgggatgaagggaaggcttcgtctgccaaacagagactcaagtgtgccagtctccaaaaatttggagaaagagctttcaaagcatggtaaatacttttaaacatagttggcatctttataacgatgtaaatgataatgcttcagtgacaaattgtacatttttatgtattttgcaaagtgctgtcaaatacatttctttggttgtctaacaggtagaactctaatagaggtaaaaatcagaatatcaatgacaatttgacattatttttaatcttttcttttctaaatagttgaataatttagaggacgctgtcctttttgtcctaaaaaaagggacagatatttaagttctatttatttataaaatcttggactcttattctaatggttcattatttttatagagctgtaggcatggttctttatttaattttttaaagttatttttaatttttgtggatacagagtaggtatacatatttacggggtatatgagatattttgatataagtatacaacatatataatccctttatttaattttatcttccccccaatgatctaaaactatttgcttgtccttttatgtcttatagttaaattcagtcaccaactaagttgaagttacttcttatttttgcatagctccagctctgatcttcatctcatgtttttgcctgagcctctgttttcatattacttagttggttctgggagcatactttaatagccgagtcaagaaaaatactagctgccccgtcacccacactcctcacctgctagtcaacagcaaatcaacacaacaggaaataaaatgaaaataatagacattatgcatgctctctagaaactgtcaattgaactgtatttgctcatcattcctaccatctacaccaccaaaatcaaccaaatttatgaaaaaaaaacagccccaacataaaattatacacagataaacaggctatgattggttttgggaaagaagtcacctttacctgatttaggcaactgtgaaatgactagagaatgaagaaaattagacgtttacatcttgtcatagagtttgaagatagtgctggatctttctttttataagtaagatcaataaaaactccctcattctgtagaagttatgatttcttttctaagagacctttagaagtcagaaaaaatgtgtttcaattgagaaaaaagataactggagtttgtgtagtacttcccagattataaaatgcttttgtatgtattatctaatttaatcctcaaaacttcttcaatttagcatgttgtcatgacactgcagaggctgaagctcagagacgctgagccctctgctaacaagtcctactgctaacaagtgataaagccagagctggaagtcacatctggactccaaacctgatgcttctcagcctgttgccccttttagagttcctttttaatttctgcttttatgacttgctagatttctacctaccacacacactcttaaatggataattctgccctaaggataagtgattaccatttggttcagaactagaactaatgaattttaaaaattatttctgtatgtccattttgaattttcttatgagaaatagtatttgcctagtgttttcatataaaatatcgcatgataataccattttgattggcgattttctttttagggcagtagctcgcctgagccagagatttcccaaagctgagtttgcagaagtttccaagttagtgacagatcttaccaaagtccacacggaatgctgccatggagatctgcttgaatgtgctgatgacagggtaaagagtcgtcgatatgctttttggtagcttgcatgctcaagttggtagaatggatgcgtttggtatcattggtgatagctgacagtgggttgagattgtcttctgtgctttcgtctgtcctatcttcaatctttccctgcctatggtggtggtacctttctgtttttaacctgctataaattaccagataaacccattcactgatttgtaactcctttcagtcatgctctaactgtaaatgaaggcttaaactgaagtagaacagttacaaggttttacttggcagaacatcttgcaaggtagatgtctaagaagatttttttttctttttttaagacagagtttcgctcttgtttcccaggctggggtgcaatggtgtgatcttggctcagcgcaacctctgcctcctgggttcaagtgattttcatgcctcagcctcccaagtagctgggattacaggcatgcgccaccacacctggctaattttgtatttttagtagaggcggggtttcaccatattgtccagactggtctcgaactcctgacctcaggtgatccacccgccttggcctcccaaagtgctgggattacaggcatgagccaccttgcccagcctaagaagattttttgagggaggtaggtggacttggagaaggtcactacttgaagagatttttggaaatgatgtatttttcttctctatattccttcccttaattaactctgtttgttagatgtgcaaatatttggaatgatatctcttttctcaaaacttataatattttctttctccctttcttcaagattaaacttatgggcaaatactagaatcctaatctctcatggcactttctggaaaatttaaggcggttattttatatatgtaagcagggcctatgactatgatcttgactcatttttcaaaaatcttctatattttatttagttatttggtttcaaaaggcctgcacttaattttgggggattatttggaaaaacagcattgagttttaatgaaaaaaacttaaatgccctaacagtagaaacataaaattaataaataactgagctgagcacctgctactgattagtctattttaattaagtgggaatgtttttgtagtcctatctacatctccaggtttaggagcaaacagagtatgttcatagaaggaatatgtgtatggtcttagaatacaatgaacatgttctgccaacttaataaaggtctgaggagaaagtgtagcaatgtcaattcgtgttgaacaatttccaccaacttacttataggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtaagtagataagaaattattcttttatagctttggcatgacctcacaacttaggaggatagcctaggcttttctgtggagttgctacaatttccctgctgcccagaatgtttcttcatccttccctttcccaggctttaacaatttttgaaatagttaattagttgaatacattgtcataaaataatacatgttcacggcaaagctcaacattccttactccttaggggtatttctgaaaatacgtctagaaacattttgtgtatatataaattatgtatacttcagtcattcattccaagtgtatttcttgaacatctataatatatgtgtgtgactatgtattgcctgtctatctaactaatctaatctaatctagtctatctatctaatctatgcaatgatagcaaagaagtataaaaagaaatatagagtctgacacaggtgctttatatttggtgaaaagaccagaagttcagtataatggcaatatggtaggcaactcaattacaaaataaatgtttacgtattgtcagaagttgtggtgataaactgcatttttgttgttggattatgataatgcactaaataatatttcctaaaattatgtaccctacaagatttcactcatacagagaagaaagagaatattttaagaacatatctctgcccatctatttatcagaatccttttgagatgtagtttaaatcaaacaaaatgttaataaaaataacaagtatcattcatcaaagacttcatatgtgccaagcagtgtgtgctttgtgtagattatgtcatatagttctcataatccaccttccgagacagatactatttattttttgagacagagttttactcttgttgcccaggctggagtgcaatggtgccatctcggctcaccacaaccttcgcctcccaggttcaagcgattctcctgcctcagcctcctgggattacaggcatgcaccaccatgcctggctaattttgtatttttagtagagatggggtttcaccatgttggtcagactggtctcaaactcctgacctctggtgatatgcctgcctcagcctcctaaagtgctgggattacaggcatgagccactgtgcccagccgacagatactattattatttccattctaccgagaaggagactaaggctctgatcatttaaataagttgcctaaggtgatgcagtgatataagtagcagagctaggaattgagccttggtaactttaactctggaccccaagtccttagctactaagctttactgcatggggtttagtcaaattaagacttttggaatatgagttacttttgagattagctttgtgatattttttgtgctcatttgtccaacaaagtctattttattttcatcttaattaggtttttgtatgaatatgcaagaaggcatcctgattactctgtcgtgctgctgctgagacttgccaagacatatgaaaccactctagagaagtgctgtgccgctgcagatcctcatgaatgctatgccaaagtggtaggtttattgttggaaaaaaatgtagttctttgactgatgattccaataatgagaaagaaaaataatgcaagaatgtaaaatgatatacagtgcaatttagatcttttcttgagatggtttcaattctggaatcttaaacatgaaagaaaaagtagccttagaatgattaacaaaatttagactagttagaatagaaagatctgaatagagcaatctctaaaaaattttgatctttttttctctttttcacaatcctgagaacaaaaaaaaattaaatttaaatgttaattagaagatatttaacttagatgtaaagtgagttaacctgattccaggattaatcaagtactagaattagtatcttatggcaaattatagaacctatccctttagaatattttcaaatctttttgaggatgtttaggaatagttttacaagaaattaagttaggagaggaaatctgttctggaggatttttagggttcccactagcatatgtaatggtttctgaactattcagaatcagagaaaactcatttttcctgctttcaagaagctactgtatgccaggcaccatgcacaaacaatgaccaacgtaaaatctctcattttggagagcctggaatctaactggaaaggtgaactaataataataatatgtacaatcatagccatcatttattaaacttttattatatgcaaggcactgtttaatttcattagcttacctggtttacagagcagctctatgagatgagtgccatctttgcccctattttagggataaggattccgaaatgtggagatggtaagtaaaattgcacaactgaagaatgagttacatgacttggctcaaatactggtcattgaactccagagcctgaatattcttaaccacttacatgatgcaagctcaccaaataaatagttcgaatgtattgtgacagagcggcattgatattcatctattcatgtggctttgagtaggaagaagaaaggatatcattctgaccagaggggtgaaaaacaacctgcatctgatcctgaggcataatactattaacacaattcttttatgtttcagttcgatgaatttaaacctcttgtggaagagcctcagaatttaatcaaacaaaattgtgagctttttgagcagcttggagagtacaaattccagaatgcgtaagtaatttttattgactgattttttttatcaatttgtaattatttaagacttaatatatgagccacctagcatagaacttttaagaatgaaaatacattgcatatttctaatcactctttgtcaagaaagataggagaggagagataaaatagttgatggggtggagaggtctatatttgaatgtagtctaaaaattgttctcttaagattggaagtatgtaggctgggagggtaaataccaaatcttggtatatcagaactgagcatgtcccttgaaggttaagaaatagttaatgggcaaatagagcatggcaatattttgtagagcagcaagtagtaggccttgaatagatgtcgctcaaaaagtaatatgtaagctgaacacaaaaatgtaacaaatgaatttagatacatatttgaatattaaattcaggttgtttgggagatgcacctagtctttgatggttaaacctttccctccatagaagagacagagacagaatggcttgctggactaatgtcccaattcaatagagtcttatctacgaaggttaaaaacaagaagagacatattatacagtagatatttattgtgtggctcatacacatggtgctcttctgattatggattttagagataataacagtgaacaagacatagtttctttcctcgagtagattaaagtcatacattgacttttaatggtgactggcattcttaatacatgattattatatattaggtaccatgtcagattaattataatactttactatttttaatttaacccttgaactatccctattgagtcagatatatttccttccattttctacttgtatctttcaagtttagcatatgctgatacatatgaagctctctccaggttttattgaaagaagaaattaataaatttattaatgtcactgaattaggcaactcactttcccaagattatgcaagtggtacaggtggaactcaaagccaagtttaactagttgttcaggagaatgttttctaccctccactaacccactactctgcagatggagataatatgatgaatggaacatagcaacatcttagttgattccggccaagtgttctctgttttatctactatgttagacagtttcttgccttgctgaaaacacatgacttctttttttcaggctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatgtgagtctttaaaaaaatataataaattaataatgaaaaaattttacctttagatattgataatgctagctttcataagcagaaggaagtaatgtgtgtgtgtgcatgtttgtgtgcatgtgtgtgtgcatgcacgtgtgtgtatgtgtgatattggcagtcaaggccccgaggatgataattttttttttttttttgagacggagtctcgctttgttgtccaggctggagtgcagtggtgccatctcggctcactgcaacctccgcctcccaagttcaagccattctcctgcctcagcctcccaagtagctgggactacaggtgcatgccaccatgcctggctaattttttgtatttttagtagaaaattttcagcttcacctcttttgaatttctgctctcctgcctgttctttagctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaacgtgaggagtatttcattactgcatgtgtttgtagtcttgatagcaagaactgtcaattcaagctagcaactttttcctgaagtagtgattatatttcttagaggaaagtattggagtgttgcccttattatgctgataagagtacccagaataaaatgaataactttttaaagacaaaatcctctgttataatattgctaaaattattcagagtaatattgtggattaaagccacaatagaataacatgttagaccatattcagtagaaaaagatgaacaattaactgataaatttgtgcacatggcaaattagttaatgggaaccataggagaatttatttctagatgtaaataattattttaagtttgccctatggtggccccacacatgagacaaacccccaagatgtgacttttgagaatgagacttggataaaaaacatgtagaaatgcaagccctgaagctcaactccctattgctatcacaggggttataattgcataaaatttagctatagaaagttgctgtcatctcttgtgggctgtaatcatcgtctaggcttaagagtaatattgcaaaacctgtcatgcccacacaaatctctccctggcattgttgtctttgcagatgtcagtgaaagagaaccagcagctcccatgagtttggatagccttattttctatagcctccccactgaagggagcaaagtttaagaaccaaatataaagtttctcatctttatagatgagaaaaattttaaataaagtccaagataattaaatttttaaggatcatttttagctctttaatagcaataaaactcaatatgacataatatggcacttccaaaatctgaataatatataattgcaatgacatacttcttttcagagatttactgaaaagaaatttgttgacactacataacgtgatgagtggtttatactgattgtttcagttggtcttcccaccaactccatgaaagtggattttattatcctcatcatgcagatgagaatattgagacttatagcggtatgcctggcccaagtactcagagttgcctggctccaagatttataatcttaaatgatgggactaccatccttactctctccatttttctatacgtgagtaatgttttttctgttttttttttttctttttccattcaaactcagtgcacttgttgagctcgtgaaacacaagcccaaggcaacaaaagagcaactgaaagctgttatggatgatttcgcagcttttgtagagaagtgctgcaaggctgacgataaggagacctgctttgccgaggaggtactacagttctcttcattttaatatgtccagtattcatttttgcatgtttggttaggctagggcttagggatttatatatcaaaggaggctttgtacatgtgggacagggatcttattttacaaacaattgtcttacaaaatgaataaaacagcactttgtttttatctcctgctctattgtgccatactgttgaatgtttataatgcatgttctgtttccaaatttgtgatgcttatgaatattaataggaatatttgtaaggcctgaaatattttgatcatgaaatcaaaacattaatttatttaaacatttacttgaaatgtggtggtttgtgatttagttgattttataggctagtgggagaatttacattcaaatgtctaaatcacttaaaatttccctttatggcctgacagtaacttttttttattcatttggggacaactatgtccgtgagcttccatccagagattatagtagtaaattgtaattaaaggatatgatgcacgtgaaatcactttgcaatcatcaatagcttcataaatgttaattttgtatcctaatagtaatgctaatattttcctaacatctgtcatgtctttgtgttcagggtaaaaaacttgttgctgcaagtcaagctgccttaggcttataacatcacatttaaaagcatctcaggtaactatattttgaattttttaaaaaagtaactataatagttattattaaaatagcaaagattgaccatttccaagagccatatagaccagcaccgaccactattctaaactatttatgtatgtaaatattagcttttaaaattctcaaaatagttgctgagttgggaaccactattatttctattttgtagatgagaaaatgaagataaacatcaaagcatagattaagtaattttccaaagggtcaaaattcaaaattgaaaccaaggtttcagtgttgcccattgtcctgttctgacttatatgatgcggtacacagagccatccaagtaagtgatggctcagcagtggaatactctgggaattaggctgaaccacatgaaagagtgctttatagggcaaaaacagttgaatatcagtgatttcacatggttcaacctaatagttcaactcatcctttccattggagaatatgatggatctaccttctgtgaactttatagtgaagaatctgctattacatttccaatttgtcaacatgctgagctttaataggacttatcttcttatgacaacatttattggtgtgtccccttgcctagcccaacagaagaattcagcagccgtaagtctaggacaggcttaaattgttttcactggtgtaaattgcagaaagatgatctaagtaatttggcatttattttaataggtttgaaaaacacatgccattttacaaataagacttatatttgtccttttgtttttcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtataggtaaggaatataaaacatggcttttaccttagaaaaaacaattctaaaattcatatggaatcaaaaaagagcctgcag

SEQ ID NO: 2 - protein, 609 aa, Homo sapiens [sequence omitted]

SEQ ID NO: 3 - DNA, 2216 bp, Homo sapiens
  CDS (40)..(1866): Exon
agcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 4 - protein, 609 aa, Homo sapiens [sequence omitted]

SEQ ID NO: 5 - DNA, 2027 bp, Mus musculus
  CDS (34)..(1860): Exon
ctttcctatcaaccccacttagcctctggcaaaatgaagtgggtaacctttctcctcctcctcttcgtctccggttctgctttttccaggggtgtgtttcgccgagaagcacacaagagtgagatcgcccatcggtataatgatttgggagaacaacatttcaaaggcctagtcctgattgccttttcccagtatctccagaaatgctcatacgatgagcatgccaaattagtgcaggaagtaacagactttgcaaagacgtgtgttgccgatgagtctgccgccaactgtgacaaatcccttcacactctttttggagataagttgtgtgccattccaaacctccgtgaaaactatggtgaactggctgactgctgtacaaaacaagagcccgaaagaaacgaatgtttcctgcaacacaaagatgacaaccccagcctgccaccatttgaaaggccagaggctgaggccatgtgcacctcctttaaggaaaacccaaccacctttatgggacactatttgcatgaagttgccagaagacatccttatttctatgccccagaacttctttactatgctgagcagtacaatgagattctgacccagtgttgtgcagaggctgacaaggaaagctgcctgaccccgaagcttgatggtgtgaaggagaaagcattggtctcatctgtccgtcagagaatgaagtgctccagtatgcagaagtttggagagagagcttttaaagcatgggcagtagctcgtctgagccagacattccccaatgctgactttgcagaaatcaccaaattggcaacagacctgaccaaagtcaacaaggagtgctgccatggtgacctgctggaatgcgcagatgacagggcggaacttgccaagtacatgtgtgaaaaccaggcgactatctccagcaaactgcagacttgctgcgataaaccactgttgaagaaagcccactgtcttagtgaggtggagcatgacaccatgcctgctgatctgcctgccattgctgctgattttgttgaggaccaggaagtgtgcaagaactatgctgaggccaaggatgtcttcctgggcacgttcttgtatgaatattcaagaagacaccctgattactctgtatccctgttgctgagacttgctaagaaatatgaagccactctggaaaagtgctgcgctgaagccaatcctcccgcatgctacggcacagtgcttgctgaatttcagcctcttgtagaagagcctaagaacttggtcaaaaccaactgtgatctttacgagaagcttggagaatatggattccaaaatgccattctagttcgctacacccagaaagcacctcaggtgtcaaccccaactctcgtggaggctgcaagaaacctaggaagagtgggcaccaagtgttgtacacttcctgaagatcagagactgccttgtgtggaagactatctgtctgcaatcctgaaccgtgtgtgtctgctgcatgagaagaccccagtgagtgagcatgttaccaagtgctgtagtggatccctggtggaaaggcggccatgcttctctgctctgacagttgatgaaacatatgtccccaaagagtttaaagctgagaccttcaccttccactctgatatctgcacacttccagagaaggagaagcagattaagaaacaaacggctcttgctgagctggtgaagcacaagcccaaggctacagcggagcaactgaagactgtcatggatgactttgcacagttcctggatacatgttgcaaggctgctgacaaggacacctgcttctcgactgagggtccaaaccttgtcactagatgcaaagacgccttagcctaaacacatcacaaccacaaccttctcaggctaccctgagaaaaaaagacatgaagactcaggactcatcttttctgttggtgtaaaatcaacaccctaggaacacaaatttctttaaacatttgacttcttgtctctgtgctgcaattaataaaaaatggaaagaatct

SEQ ID NO: 6 - protein, 608 aa, Mus musculus
MKWVTFLLLLFVSGSAFSRGVFRREAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALA

SEQ ID NO: 7 - DNA, 2079 bp, Mus musculus
aagcttgaaaacaggactgccttagaagtaactaataattatgtggctcatcctctagtatagagtctacatataggacgagtgcccaggagtttcagaaggaagagtataaattcttactcaccagatgcaaaagtgtttctcttcagttgaaatgatctgtgagcacggagactgtgtcaagaattaagcactttaattctcggctgctaaagattaattagaacatgcccgagtaaggcattgtgttagtactgcctaaggagaggctcagttgttattaatttatgtcttaaaagtattggagcttcatcagtcactaaaccagctcaagcgcctacttcattctgatgcttttctctccaggctttggctgcatagatgatttttttttttttttttacttaattgtcaaacaaaagtatatatagtatacatagtacatgtgagagtgctaaaagcctgagttaataacacaatattatacttaaacacaatattacatataactatatagtacttgtgagttaataatacaaatacattcaatgacttaagcattacatacttgtttatgtttatcaagacccacaccaggacaggactaggcatgactactgtcttcaaataaatagtgactactctttctaggaagtttaaagaggaattgatccaagaaagaattatctcttctgtttagtttctttttttcttttccaggatggggttttggcttaattctgccacccaccctcaccctcagtagaagttattccatgggcagactttatctatctatctatctatctatctatctatctatctatctatctatctatctatctacctacctacctccctatccatctatcatctatctatctatctatctatctatctatctatctatctatcatctatctatctatctatcattctgttcatctgtgtagaggctagtctgttattccatttcaggactcttttgagtgataaaacaagcaaggaaacacttttcccttctccttcattttgccttgactcctgtggttgattacagaatttgtacacctttctgaagatgaggacacaagatgaggtcataagacatagatttctttcattgtataaccagatataaagaagaatgcttctcctcctcctcctcttcctcctcctcctctcttcctccttttccttcttctcctccttcctcttctccttcttgtcactgaatagtccctgtatatttaggaaccatggggttgatttggatgtagtcttgactgactcataagtgagataactggtctgctactaattattatcctgtggtgttagaggaagtatgttacgatggcaaagaccatcatcactgtcattggagtgcctgttctagtgtctcctctaaagcaccccgagaaagaggttcatgttagatgaaaacattctactccagacccgtttcacacatagcctgagcatggggtggggacacaagacttctgaaagtcctctgcacttgttttttattgctctggcttcttctcagttcacatttgagacactgtgtgctttatggaagattctaactttaaaaagatgagaaagacttggaagccctataatgagacccacccctccctcatacacattcttcattacctgtacataaaagcatatttgggatgaacaacctatgcaattcagttcttagcttttaaatgtggcatgcttccatgccaaggcccacactgaaatgctcaaatgggagacaaagagattaagctcttatgtaaaatttgctgttttacataactttaatgaatggacaaagtcttgtgcatgggggtgggggtggggttagaggggaacagctccagatggcaaacatacgcaagggatttagtcaaacaactttttggcaaagatggtatgattttgtaatggggtaggaaccaatgaaatgcgaggtaagtatggttaatgatctacagttattggttaaagaagtatattagagcgagtctttctgcacacagatcacctttcctatcaaccccactagcctctggcaaa

SEQ ID NO: 8 - DNA, 900 bp, Mus musculus
ttagcaaacatgtctggacctctagacacacagactctgacacgccaacgtctgagttctagtttcgatacgcactgggaagttttaaaagttttccatcaactctaatgtgtagagaaatggaaactatcatagactctacgacattgagggtgaaggtatgagtgaagcactcttagggtcagaagtatgtcagtgcccatttgttgctgttagcatcatcatcttagggcttgagaggatgttgcagctgacccatgcacctgtgacatacatatggaattattctttggcacataaaattagaatgggagctggctcatcaggttttgtgctgtaagttttctatgttaaaccagatgcgatacactaaataaaataaaatatacttgaccgatggttttgagcgaaataataactggataatcaagaaatatatcccactaatgaatagcctgaactactgaaacaatttgttcagtgcctagcatatggtgtgcattttattatttctttcaaaaagaatgtatttggagttacatagtaagtctgctaccttttctttatggctatatctatgtcttatgttgagatgaatgaattattcttcaggggaaataatctatttgaacagtttagatggtgaagaacatttgcagcatttgcaagatttttttccactctgaagtggtctttgtccttgaacataggatacaagtgacccctgctctgttaattattggcaaattgcctaacttcaacgtaaggaaatagagtcatatgtttgctcactgaaggttactagttaacaggcatcccttaaacaggatataaaaggacttcagcaggactgctcgaaacatcccacttccagcactgcctgcggtgaaggaaccagca

SEQ ID NO: 9 - DNA, 4133 bp, Mouse
  mRNA (634)..(750): Exon 1
  Intron (751)..(1090): Intron 1
  mRNA (1091)..(1233): Exon 2
  Intron (1234)..(1440): Intron 2
  mRNA (1441)..(1511): Exon 3
  Intron (1512)..(2064): Intron 3
  mRNA (2065)..(2172): Exon 4
  Intron (2173)..(2308): Intron 4
  mRNA (2309)..(2412): Exon 5
  Intron (2413)..(3829): Intron 5
  mRNA (3830)..(3910): Exon 6
  CDS (634)..(750)
  CDS (1091)..(1233)
  CDS (1441)..(1511)
  CDS (2065)..(2172)
  CDS (2309)..(2412)
  CDS (3830)..(3907)
gatcctgtgcacagaccctggattgggcacacactattctagacagatcctttcctgctgtaaatactgggagctttgctgaactacattttcaactcagattcacccctcttttttgggcattcggctgcctctaggctgtataggggtccccaggaacatcacactcctttggaaactaatccatctttgtccttggcccttaacttgagcccctaagtgtcttctaagttcactatgaaccctgaccagggtccccttcatagcccccttggagggtgataaacgaataggtctcactcctgctaggcacttcatgggataagacaggtatgggacccatgactgggatctaagtattatcaggctagcccagtatccaccttgaccatgaatcagccactctggtgtagggcaggagtctgtgtcagggccggctgggagggagctgcacaaagctggcttgagagaacattttgcgcaagacatttcccaagtgctggggagaatgtgccagggctctagaggccctgctgcagtcccatgccctcgccacatctattataaaagccactgtaccctccatccaccagttatctcttccaagccctggtgcctctgagtgtcctaagcatggcactgcacatgattcttgtcatggtgagcctcctgccgctgttggaagctcagaacccagaacatgtcaacatcaccataggcgaccctatcaccaatgagaccctgagctgggtaagtgcctgcccaggacttggacgtgagcacttaaggaggctactctttcctctgggctttcccttccctgatgtctgtgctcatctctgggctcctggtactgccctttcctctcctggagacctggtggcaccccctgcctccaaacccagaagcatcactctgaggtctctcagcaggggacagagcagtaggatggctgatttttgagttgcccatttgagcttcagtcttcccatgtatggttcagaagccattgcttgcttgccccacagcacggctgagtgcaatgttcatactacaagccctactcatctgtgtgcctgcttctccccagctctctgacaaatggtttttcattggtgcggctgtcctaaaccctgattaccggcaggaaattcaaaagacgcagatggtattttttaaccttacccccaacttgataaatgacacgatggagcttcgagagtatcacaccatgtgagttcttgtaacagccagcccaccctggccctggcctccactcccagatgcctagagacctgagcaaactggatctgcctggcctccccacccaccttctggaatggggacagctttcttgtttacctgcctcttgcccactccccaccccagtttagtcagatcacctctccatcagttgtcctctgtctctttgctttctagagatgaccactgtgtctataactccactcatctaggaatccagagagagaatgggaccctctccaagtatggtaagggttggaactcacggctttctgggagcgtattgcaagggtacaagggggcagcagaacaggggagttaggtctgtgaagtcactctctgaggcttgtaagtggacgtagatttcaaactggagtccagctgccaggacagacttgctttgaccattcttatgatcttttgtgagctcagaggggaaacccatggtttgggaaaccagtgacttcagccaaatccccaggtcaccagggacagcatggggggagggcaactgaatactggtgggccagattagatactcttaggtttaattgtccctaagccaattgttttaatgtttaaggggaagtgttaactatgccacaccaccaagggccctttccaaggccccagccattccatacttatgaagaatgagaagtgaggctgcatccaacagaggctgagcacatggcagccacagggagcctcaggcacttgtccatagctatgtgcttccttcccttggggatggggaccacagcatcattctagtgactcacaaagcccttcatcctgcagtaggaggagtaaaaatctttgcagacctgatagtcttgaagatgcatggggccttcatgcttgcctttgacttgaaggatgagaagaaacggggactgtccctcaatggtagggtcctcccagacctggtccccagctccactggccttactcttgatcgtccacccacatcccacatccctacctggcttcccatctgctggacccttagccagcacaatcctggatcccttctccattgcagcaaaaaggccagatatcaccccggagctgcgggaagtattccagaaggctgtcacacacgtgggcatggatgaatcagaaatcatatttgtcgactggaaaaaggtaaatgaggaggctgtatgataccaccccagcagtgctcccattgtcagtgacctagcggctagagagggcaagcttccggttaaggcagctcagcaaggcaggtatcctgccattaataactctcctgcctactgtgagagctgagatcacagagatcctagatgggcagtgagcctcagggaggtgaagttaagtaggaggtcctggaaagcttgtggaggataagaggaagatcaggagggtcacttagggaacagccagtgccagggtgccaggtttctcccttcatattcactacctatcgaagcaggagtcgtgattgaagtttccatgccacccaactccaacaagcccaatcacaggcggggatgacccatgcggaaacctcttgatgttctgtctaaccttgtgctgagggagaggccaaataaactttggctttcaccctggtaaagccgtgggatcaaccaatcagcttgcatgtagtctgagatacacaatagtttgtgactccaatctctggtcacctgagcctttcctggcatcaccacccccaggatcttccccgggggaggggcctgccatacagacatgccagcagccatttcacagcatgacttcctcacccccccccccccaaccattggggccagtagtctcactctgcacctgtggacacaagtgttccgaaaatgcctcccgtttgcggtattctgttcacattcaatggggtgaataaaccagagctcagagatgagggacaacttaccctagactagtggatgtgctcaagggtgggtctcagtctgtatgtcagatgtcctgcatgtcatatacttcagatttataacagtagcttaatcacagttatgaaggagcaatggaaacatggttgggggtcaccacaacacaagaaaccgtggaaaaggttcccatctctaggaaggctgagaacaacagtcctggatctgcaggggagccatggtagatgcaagatacagcgtgctgacatatcctgcccttctggccaacctctgtgcttcccccctttagaaagtactcatagctagtgtgtgtgtgtgtgtgtgtgtgtgtgtgtgtgtgtgtgtgtgtgtgtgtgtgtgtacacaagcttgtcataagatgtgtgtggatgtcagaggacaactgtgggcagtgttcactccagccattttatcatggactctgatgattgacttcagagcttacatactttgccagggtttttgttctgcttgtttgttctattttgttttgtttttgcatctaaccttgcagcccacggctaccctactgcaactcatagcaatcctccagcctagtattccccaaccctaggtgtgtgccaccacacctggcttactcactctgctctcctcctgatatcttccaggacaggtgcagtcagcaggagaagcagcagcttgagctggagaaggagaccaagaaagatcctgaggaaggccaggcatgaactcagctctctgaactccgagggctgtccacaggctcaccaaaccccacccctcctgtgcactttgattctgtctctgccacaataaaggtttgctgacacagtcaatatcacttctttgcttctttcctttttctccctccctccctccctttgtgcagagtcctgagtggagccttagctaagtccaagaagccctgcccaggaattacgacgctctgga

SEQ ID NO: 10 - protein, 207 aa, Mus musculus
MALHMILVMVSLLPLLEAQNPEHVNITIGDPITNETLSWLSDKWFFIGAAVLNPDYRQEIQKTQMVFFNLTPNLINDTMELREYHTIDDHCVYNSTHLGIQRENGTLSKYVGGVKIFADLIVLKMHGAFMLAFDLKDEKKRGLSLNAKRPDITPELREVFQKAVTHVGMDESEIIFVDWKKDRCSQQEKQQLELEKETKKDPEEGQA

SEQ ID NO: 11 - DNA, 4002 bp, Mus musculus
  mRNA (594)..(707): Exon 1
  Intron (708)..(964): Intron 1
  mRNA (965)..(1107): Exon 2
  Intron (1108)..(1303): Intron 2
  mRNA (1304)..(1374): Exon 3
  Intron (1375)..(1942): Intron 3
  mRNA (1943)..(2050): Exon 4
  Intron (2051)..(2188): Intron 4
  mRNA (2189)..(2292): Exon 5
  Intron (2293)..(3704): Intron 5
  mRNA (3705)..(3785): Exon 6
  CDS (594)..(707)
  CDS (965)..(1107)
  CDS (1304)..(1374)
  CDS (1943)..(2050)
  CDS (2189)..(2292)
  CDS (3705)..(3782)
ggatcctttcctgctgtagatactgggagctttgctgaactagatgttcaagtcagaatcaaccctttttgggcatttggatgcctctaggctgggaaggggtcctcaggaacatcacactcctttggaaactaatccatctttgtccttgggccttaacttgagcccctaagtgtcttctatgttcactatgaacttgacctgggaccccttcttatcatgcttgggggcgggttgatgtatgtgtaggtttcactcctgctaggcagcttcatgggataagagagggtggggaccactgtctgggacctaagtatcatcaggctaccctgtacccaccttgaccatgaatcagccactctggtgtagggcaggagcctgtgtcacagccagctggctgagagagctgcacaaagctggcttgagggaacattttgcacaagacatttatcaagtgctggtgagtttgtggcactgctctacagcccctggctgcagtcccatgccctccccacatcctgttataaaagccactgcaccctccagccaccagttatctcttccaagctctggtgcctctgagtatcctcagcatggaactacacacggttctcatcatgttgagcctcctgccactgttggaagctcagaacccagagcatgccatcaacataggcgaccctatcaccaatgagaccctgagctgggtaagtgtctgcccggggcctggacctgttcactgtaggattctactctttcctctgggctttcccttccctggtgtctgtgttcagctctgggctcctggtactgcccttcccacttgtgtataccctggtggcatccccctgtctccaaaggcagaatcatcactctgagccatagcttgcctgcccctcatcgtggatgaatgccaaggtcctcactacaaggcctgctcatctgtgtgcctgcttctccccagctatctggcaaatggtttctcattgctgtggctgactcagaccctgattataggcaggaaattcaaaaggtacagactatatttttttaccttaccctaaacaagataaatgacacgatggagcttcgagagtatcacaccaagtgagtccttgtaacagccagcccaccctggccctggcttccactcccagattcctagagacctgagcaaactggctctgcctggcctccccacccactttcagaaatggggacagctgtcttgcctcttgcccccttctaccctgggctagtcagatcacctctccatcagttgtcctctctctttgctttttagagatgaccactgtgtctataactccaaccttctgggattccagagagagaatgggaccctcttcaagtatggtgaaggtgtgaactcactcctttctgggagggtattgccagttctgaggggacagcagaacagggcagtttggtctgtcaagtcactctctggggcttgtaagtggacgtagatttcaaactggagtccagctgccaggcctgacttgttttgatcaggctttatgacccttcgtgacctcagagtggaaagccatgggttgggaaaccagtgactttagccacacccccaggtcaccagggacagcatggaggagaacaacccaattgctggtgggccagatcagacactggttagcttttaattgtcctaagcagatgttttgatgtttaaggggaagtgttaacattattattgccccaccaccacaccaccaagggccctttccaaggccccagctcttccatacctatgaagaatgagaagtgaggcttgcatccagcatgaggctgagcacatggcagcctcagggagccccaggcacttgccatagctatgtgcttccttcccttggggatgtgaaccacatcatcattctagtgactcacaaagaccttcctccaacagaaggagaagtagaaaacccttctcacctgagagtgctagagaaacatggggccatcatgcttttctttgacctgaaggatgagaagaaacggggactgtccctgagcggtagggtcctctcatccctggtgcgcccagctcaactggccttactcttggtcacccacccacatcccacatccctacctggcctcccatctactggacccatagccagcataactttggatcccttctcccatgcagctagaaggccagatatccccccggagctgcgggaagtatttcagaaggctgtcacacacgtgggcatggatgaatcagaaatcatatttgtcgactggaaaaaggtaaatgaaggaggctgtacgataccaccccagcagtgcgcccagtgtcagtgaccctagaggctcagagagggcaagcttctggttaaggcagctcagcgaggcaggtatcttgttaactctcctgcctcctcctcatcaggagatcacagagaccctagatgggcagtgagcctcagggaggtgaagttaagtaggaggtcctggaaagcttgtggaggataagaggaagatcaggagggtcacttagggaacagccagtgccagggtgccaggtttcttcctgtccttcatattactaccttttcaagcaggagttttgattgacatcttccatgtcaccccaactccagcaagcccgatggctttgataggcagggttgaccacactgagactcttgatgtccggtctacacattgtgcagagggagaggcagcatcagttttgtttttcacccatggcgaatgcatgggatcaaacagtcaccttgcatgtagtttaagatactcaatagcttttgtaacttcattctctggtcacctgagcctttcctggcatcatcaccagccccaggattcccgggagaggtgcctgcacacagacactgccattcacagcatgacttccacccacaccagtgggccagtagactcatcctgcacctgtggacagaagtgttagataatgcctgccctttggggattctgctcacaatcaatgggtgaataagccggagctcagagatgagggacaacttaccctagactagtggttctctaggatgggtctcaacctgtatgtcagatgtcctgcacgtcaggtatttattgatttataatagtagcatataattacagttattgaagtagcaatgaaatcatggtaggtgatcaccacaacacaagaaactgtgttaaagttttgcattattaggaaggctgagaaccactgtcctgccactgcagggagccatggcagatctaagacacatctggttgacactaccgggccattttgaccaacaacagtactccccccaacccacctcacaataggtgtattcatagctagtgtgtgtgcatgtgtgactgtgtgggtacacaagcatgctataagacatgtgtggatgtcagaggacacctgtgggctatgtcctcttctaccattctctcctgggctctggttaaggctgggttggcttcaagctgcccctcaggcttacctaccttgccatttttttttgttgttctgtcctgttttttctgttttgttttgtttttgtatttaatcttgcagcccaggctactctactgcaactcatagcaatcctcttgcctcagtattcatcaaccctggtgtgtgccaccagccctggcttactcactctgctctcctccctgatatcttccaggacaggtgcagtgaacaggaaaagaagcatcttgagttggagaaggagaccaagaaagatcctgaggaaagccaggcatgaactcagctctctggtctccttgggctgtccccatgtgtaccacaccctaccccatcctggtcactttgattctgtctctgtaacaataaaggtttgctgacactgtcaatatcatttctttgctcccttccttttcctccctccctccctcccttcgtggagagtcttgagtggagctagctaagtcaataaccctgccaggaattcgaaaggctct

SEQ ID NO: 12 - protein, 206 aa, Mus musculus
MELHTVLIMLSLLPLLEAQNPEHAINIGDPITNETLSWLSGKWFLIAVADSDPDYRQEIQKVQTIFFYLTLNKINDTMELREYHTKDDHCVYNSNLLGFQRENGTLFKYEGEVENPSHLRVLEKHGAIMLFFDLKDEKKRGLSLSARRPDIPPELREVFQKAVTHVGMDESEIIFVDWKKDRCSEQEKKHLELEKETKKDPEESQA

SEQ ID NO: 13 - DNA, 803 bp, Homo sapiens
  CDS (79)..(681)
  sig_peptide (79)..(132)
  mat_peptide (133)..()
gcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttggggccatcctgcccctccaacccgacatgtgtacctcagctttttccctcacttgcatcaataaagcttctgtgtttggaacagct

SEQ ID NO: 14 - protein, 201 aa, Homo sapiens
MALSWVLTVLSLLPLLEAQIPLCANLVPVPITNATLDQITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 15 - DNA, 606 bp, Homo sapiens
  CDS (1)..(606)
atggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctag

SEQ ID NO: 16 - protein, 201 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVAHLLFLRDTKTLMFGSYLDDEKNWGLSFYADKPETTKEQLGEFYEALDCLCIPRSDVMYTDWKKDKCEPLEKQHEKERKQEEGES

SEQ ID NO: 17 - DNA, 4944 bp, Homo sapiens
  mRNA (1609)..(1722): Exon 1
  Intron (1723)..(2137): Intron 1
  mRNA (2138)..(2280): Exon 2
  Intron (2281)..(2498): Intron 2
  mRNA (2499)..(2569): Exon 3
  Intron (2570)..(3273): Intron 3
  mRNA (3274)..(3381): Exon 4
  Intron (3382)..(3531): Intron 4
  mRNA (3532)..(3635): Exon 5
  Intron (3636)..(4775): Intron 5
  mRNA (4776)..(4841): Exon 6
  CDS (1609)..(1722)
  CDS (2138)..(2280)
  CDS (2499)..(2569)
  CDS (3274)..(3381)
  CDS (3532)..(3635)
  CDS (4776)..(4838)
ggatccgctgaaaaatgaaacagaaatgagtcgtgatgggcagggagggagaagcaagggagacgagaagtggggaacatggaaggaaaagccacgtgaggaagaaaccagaggtcaagagaaaaagaatcatggaggtagaggaagcaaaaaacacacataacaaagaatgtggactttggagtcaaactaatgtgagtccaaacccaggctctctcccaaaccagtttgcggcagatggccagtggaacctcactctcctcatcagtaaaaagggggcagagtgagggtcctgagagctagtacagggactgtgtgaagtagacaatgcccagtgtttagcgtaagaatcagggtccagctggtgctccctaaacagcagctgctgttcactgttgaaaggcgctctggaaggccaggcgcggtggctcatgcttgtaatcccagcactgtgggaggccgaggtgggcggatcacctgaggtagggagttcgagaccagcctgaccaacgtggagaaaccccatctctcctaaaaatacaaaattagccaggcgtggtagcacatacctgtaatcccagcgactcgggaggctgaggcaagagaattgcttgaaaccagcaggggaggttgtggtgagccaagatcgagccattgcactccagccagggcaacaagaggcaaaatggcgaaactccatctccgagaaaaaaaaaaaaaaagaatactttctgaaagtatttattcatacaaataaagacttgacccataaggtaggaacgcaaatgggccacggaatcactcattccacagtatacaccgagtgcccttgaagtgctgggcactgctccaggattgggggcatattggtgaaaagagaagcaagcctgcctgctcagatggcagggaatggggaaaaacagggagacagtttcctgtttgagatgttgggagtctgcttcgagtagtatatttactggaaatagaccactaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccggtgagagcccccattccaatgcacccccgatctcagctgtctggccagaagacctgagcaagtccctccttcttcctggccttggccttcccatgggtggaaccgggagggttggctttaatctccaccagaactcttgccccgggactgtgatgggcgattggccacttctcctcgataacattactgtttttcttccgccttctggttgactttagccagaaccagtgcttctataactccagttacctgaatgtccagcgggagaatgggaccgtctccagatacggtgagggccagccctcaggcaggagggttcaccgtgggaacagggcaggccagcataaggtgggggctggatgtagagccctggaggctttgggcacagagaaataaccactaacatttttgagctcttaccacgtgctcagaaaaaatccctaagaagacactgagagaattagatgaggaaacataagaacagagacctcaaatagtttccccaaggtcacacagcttataattagaactagaattggaactccaggctggcttcagatctgcctctctctcacgccctctttaagatcctttgcaaaccaatggtagaagcctgtatgttggagaggtggtaccttcaactatgtcccccatcaccgcagaggtggcacatggcagggatctgatggagctgaactgacatcatttagcatcccgagcctcctctctgggcctcattttcctcctctgtaaaacggggagaaaggccctgacagccacagtctgtgtgaggctcctgagatctcatgtacagaaagtgcttggcgtggagctgggcacgcagcaggggctgggcacacggtggcccaaaggagacccgggccttcactgatgggctttgtggccccggacacacctaggactcctcacctgtaagacaggcaccattgtgccatcccatgttctcacccagaggctctttttctcttccagagggaggccgagaacatgttgctcacctgctgttccttagggacaccaagaccttgatgtttggttcctacctggacgatgagaagaactgggggctgtctttctatggtaggcatgcttagcagccccaaactcatgcccctctcaggcctcaccccccattcacccacccctgggctggcccctagaaccccagccctccctggcctccgccgggccccaccatgtccccagtcagtctccttgctccccctgcagctgacaagccagagacgaccaaggagcaactgggagagttctacgaagctctcgactgcttgtgcattcccaggtcagatgtcatgtacaccgactggaaaaaggtaaacgcaagggattggacattgcccaccttgtccatggcccaacttgggcagccccagaggcccagagcaggaaagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccaacctccactccccgctcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagctt

SEQ ID NO: 18 - protein, 201 aa, Homo sapiens; identical to SEQ ID NO: 16

SEQ ID NO: 19 - DNA, 125673 bp, Homo sapiens
caagaggagcatggaccacccaactggcacatcgttgccatcctgcacctgacggcccctgaggccctttccagctcagactctgaacagcgatgaattctaaaagcagagagagacccaaacttaatttgatggccatttcaagaactgttgtccaggggcgtctctagagctggaagggcaagcctggttgaggttcagccagggactctgttcttgctgtcattcccgagcttgctgggaagaaaagtcgaaagactggcctccctttcctcatctgagaagtaggattccaccaaggagttccatgcaggcttactccagctccagtaatagtatctcacatggttgccaggtatggggcgcttacaccatgccttacagcaacccttgaagaaggtggtgtcagccccatttttcagataaaaaaacagatgccaatgagacctaagtagtttgcttgcggtcaaacagccagtgaatgagaaaccaagaagtagcattgacgtctggctgatgtcaaagcctgtctttaactactaggccactctgcagcccagccaaccagcctagagatgatgttcaggacaaatccatgacaagcaccttctaaattcgtgacctcatgtagcccccaccccacgtcaccctgcagagggagctgtcggtagcttgggggtctgctccccttttctggagagctgagggtgggcacctcaaccttcctgttcatttgctaactcagcccctggctaccatgcacccactgtgtgccagggcccccagggtcccactgcctggagatccatgggtcagggtcctgccccagggagggggaagagaggaaaagcacaccggggcctcctccccagtaacatctcctcctctttctccatcaccttttccagggagagccaggccttgagggtgacagtggccccatgggacctgatgggctgaaggtaagtgcccttttagggcagggcctggggaccccggcagggcattgctttcccatccaagacctaagtctcctcccagaaacactgtgttcccatagagatctgagatgacagctccagctcccattgacagcagcttggggaagggtcagcagtgtccagcagccacctcccaccctgccctctgcactacctgctcaggtgggaccagggccatcaccaccttccagtctttcctgctacccttcttaaaatatcagcttctcttggctaagggtgattcctgagcaccggcactacgccaggcccagagccagagtctttggtctctgttatcttccaaatattctagaaggtcaggaaaataataattaccaccaatgacttataagccacaatttagggaggactagtcacacacataccaggtacaacgctaagccctttaccagctggatccataggacaacggaagttctgtctttagatgaggaaactgagactcagagtggtgaagcaacttgcccaaggacacaccgctagcaactggcacatccaggacccaaatctgggcccgtttggctccaaagcctctgctcactctgctgtaccatgcacccattctaaaggcgaagaggctgaggctcagaggaaggcatagatacattcaggacctatggctatgagtgaggatccaaaattcaaacccacggctcacaggtgccaaagcctgctggcccaacttgaccctgctgctccctgagagactcctgtcagccacaaatgtcaggactctgaagagacaccttagctcacctgaattgcaggtgggcaggcgggcacctccctctgactctccagacccatctccaggccagtccctggcctccgtcttgggccccgctctgaccccacaggtgggctttccccgaggctggccggtcaccctgtgcaagtcagctccccagcccaggttcctaagggccatgccctctcgcccacctactctccaggtgacctcagagaagcagaccccttctctgaacctcagtttccccatccacaggcttccgcccaccctcgttaccccctccccacagtctcccagggtgccttggcgaccggcccctgctgactcctcacattttcttgcaagagcgagagcaccccctgtctgtcatctgcctgactcctctcccccaaccctgctgcatccaagcgtacagccgagtcccaagacccggagcatttgacagctgctccacaccctttgccagtgcctgctacactgggtggtgatgctgatgaaggtcatggctaaaatgctttgggcacttgccatgtgcccagtgccacccacccaaagggctttatgtgaattaacccatttaataattaatgttcccagcaactctcccaagcttgatacattaccatcctcactagacggatgaggaaactgaggcacgaagcagcagccttctcactccactctgggcggccacctttcttcttggaaagtccactgaggtgggcgggagggggtcttccagcctgggtgcctcatgcagtcttctgcctccaccttgcatggctttttggccctgacttcatcctcttcccctcccttcaaagccaattctacctgagtccttgtgctcaaatgcacagcatcttccctggtctttacatgaatcccaggagagacccattttcttaaggtgtttgtccaggaatcacccctcatggtgaaaactgcgtctcgaatatgcacagcacttcatagtttatagagtgcttttacacccgttatctcttcgctgatgtccagctgacagtgatgatggtggtggtgaccaataatagttagcttttatccagcattcacatgccagacacactgctaagctatttacatggtttatctctttcaatccttgcagtaatcctttgatcctgattttacaaacgaggaaacttgcccagggtcacacaactattcagtagcggtagcaagatttgaacttaggcagcataacccgagggttgagggaggcatcgtcccctgagcagagaatcttggaattagaaggagccagaaccccaggttcacacagcactgactcactcggtggtattagggagtctccacctgtctgcacttcagttgtcccatctgtaactgaagagggttaaggaaggtgacttgcaaggctcctctgagcactggcagatgtctgaggatttggggcatctctaggaacccccagagactgttctgcatgagattcacaaggacgcccaccccaggggtccagttagcccctggagtgtggtcttaggcagagcccaggtgagggccctttgttgaaaacccgactagccacctggaacaggctgtctgcctctgagaggagaacaggtggccaggacgacaagccagaaatggaatcccagagccagaggagtctgcaggagagttattcaggccagccccctgtcttcatgccaggctgtgcttagaagctgaggctcccagcaggaagggatccgggcacaactttgtgcccagatctgctctacattggcccacgcctcagctcggagtcttctgcctttatctgtgccatctctggaccgctccattggaaaatcttcccaactgaactagaaactgccccagcaactccctcacacccacctcctgccccagagctcaggcctcagcaggcccagcttgaagcaatgagcaatcatgagttgctttcttgagcctctcttctaggcagggccaagccccaggctccagcttcatgccctctgcttcctgtgctctctctcctctggatgcacaccagtttatcagtgtccctcgtaaaccttggcactgggggacagaactggtaaagacacactatgcttttccaagcctgctcttctcgcccatcccttcctgatggacgccgcccctcagcagccatgcccgtgctgcactccacacctgctctgctcacggtgatgagggtgacagcccacgccccatcctggaatcctgcatgccccatcctggaaccccacctgcccccaatctctctcagagtacgcaaagattaccgtgatgagataaggcaagcttagagtgacactgattgcttcaaaaccataaaaagcccatgccagcctggtgcagtggctcacacctgtaatcccagcactttggaaggccaaagtgagtggatcatctgaggtcaggagttcgagaccagcctagccaacatggtgaaaccctgtctctactaaaaatacaaaaattagccaggcatggtggcgcgtgcctgcagtcccagctagttgggaggcgggggcacttgaacctgggaggtggaggttgcagtgagttgagatcatgccactgcactccagcctgggcaacagaatgagatccgtctaaaaaaaaaaaaaaaaagcccatgccaagggttgcctttccaaggaaataacctcaggtgccccaaaggtccgaagccccaagaagaccttggttacagccctatcactgtaaagaggatacgctcaggatcctgcttcaaagtccagctccaccgctagccagttgtgggcctctgggccagaccacttgatttagctctgcctcagtttcctcttctgtaaaatgggactaaaagcggaccagccttagaaagcttttgtggggattaagtcagttaatagatgttaaaggactcagactatggtcctgacatggttagtgctatataaatgttagctccatccactccccagagaaagtattctgcagccaataagaatgatcgccatgcagagcccagagcgataggagggcacgttcaccatagagcaaagcagtaactataacaaacaaagatggagaccagcagtccagtgggattgtgcctttagagcttagtttactgctgtccgattcattgccttgggagagttgcttcactgccctgagcctggtacataccatccaaactgttacctaccatttattattattattattattcactgtgtttttgtcatcgaggattgaaaatacaactcagaaaaatggaaagagtggttctgagaaggagaattgggtgaattttctttcttgatgaaaatttctttcagctagttgcagcagctcatacctgtaatcccagcactttgggaagctgaggtgggagaattgcttgagcccagcagttggagaccagcctggtcaatggtctccaactgctgggctcaagctctcttgtagcaagaccccatttctacaaaaaaagaaattttttttcaattagctgggcatggtggcatgtgcctgtagtcccagctacttgggaggctgaggcaggaggattgcttgagcccaggaggtcgaggctgcggtgacctataattgcgcctctgcactccagcctgggagagagtgagactctgtctaaaaaataaaaaaaaaaaatctgcttcataagactcttgttctcccaatgtgtctaagttggagagaaattgcccttgtctcctgtgaactccatggggtgggtgcagtcaggaccccggcttatctctgagtcactctgcccttcgcagcccaggcccaggcagggacacatgggagcctctacgtctgggatgcatccttgtgcaagcttagagctacactgggcttggcagccgagtcacagcaccctgcctttttggctgcagagggaactatcgagaatctagggaccagttggctgtggatgcctgaatggagccctgagatttggggcctctgatgcacttggcaactaacttattctctctctctctcccctcttcatgccctgccacccagggggacaggggagacccagggcctgatggagaacatggcgagaaaggccaggaagggctgatgggtgaggacgggccccccggcccccctggcgtcactggtgtccgggtgagtgtgcaggccccttgcagcgcctggagctctggggtaccctgaactctcatgcctgtgcaggcggctgggcgggagggcttttggtcgtgccactgaaggatcttctgctgtggtcctttctccacctggcagtttgccagagaaccaatctgctcaatgctccatggctctggagaacaacctcggttactcatcctcctggctgccctgccctgtgcaaacctggtccctgccgacctcatctcatccatcccccatatccagacacactaaacttttttcagtttcttggacaagctgtggcccttacccctgggcctttgcatgtgctctgtctaggacactctcccttcttcactcccctgtcacctgcttaagttctatttggccttcaggtatcaccatagacatcacctgctccaaaaagccattcctgcccccaggctgggccatgagccctcagggacatgcataaccttcagtgtatgtcttggctccatgaagaccaagaccttttctggccttcatttacgtctttaacagtgccttggccaggtgcggtggctcacgcctgtaatcccagcactttgggcagccaaggcgggtggatcacttgaggtcaggagttggagaccagcctggccaacatggtgaaaccccgtctctactaaaaatgtaaaattagtcaggcatggtggcgcatgcctatagtctcagttactcaggaggctgaggcaggagaatcacttgaacctgggaggcgggggttgcaatgagctgagattgcgccactgcactccagcctgggcaacagaacaagactttgtcacaaaaaaacaaacaaacaacaacaacaacaaaaccagtacctgacacataagaggtgaccaaagtctgtttgttgattgagaagacggaggaactctgctcttccaccctaacagaaatgtacttagtcagtccacagaccctcacgagcatcttccctgggccaggtcccctgagattgaagaggtaaatcagaaagcatccctgactttgagggacatagaagccagtagggaagggagcagaattctcctgtttcaacatgtacagacaagttgcccaatgctttctcgaaggttccctctttgataccgatagcaacccctgaggattgggaaaatcggagaggtaaaggaaacttcccaggctcacacagtgagaaatgacaaagctggaatttgaacttaggcctgcatgactctacgcatactgcccctgtgctctggcagagttggaatccagggcttggctgtggggctgtgaggatgagctggaggcaggtggaagcttgatttttgagtgtcgcaaatactggactgatgactcggaacttgacttggtagtggggggcagtggtagtcttgtacagttgagcagggtttgtgtgacccaggagtgctgggtcggttcagttgaactccttgggacccgtggattaggtggcctcgtagacaaaatgcccaaatgcacaggcctgctggcatctaccttgagccaaccaggtggtgagaactcatgcctctgctgccatcccagtctccctggggtgtcattttcactcttcatccctcaagcggagagactgacgttgttacctaggcaaagcagcccagtttgattcaggcctgctcttgacactgtttttcccccctgaagtgtttacatgactaacctaggacagatccaagttagcctgcaacaaactatggttgtgggaaaatatttgtttcctaaaaatagcactgaagtgccaatccccctaaacagctgcaacagaatgaactcaccaaactagagaagaatacgagggcgctgagtcagccaggaggcttcccccaggcttgactcagtggcgggcttgactcagcggcggggaagtaggccaaggggaatttagcaggagggtcccgggccaggattctgcattaggaacttggtctgcgacctttcacccgccccctgccctctctggttttgcccttggagggtttggaaggaatgtgtgctaagattactttgagctccagcgttctagggacccttttttagtgagtgttgagtatcatggctgtggaatgggcaggaacacatggcagaaatagccttggaaccagagtcctgaggttgaacttgagtttctggctctagtaacccattctctgtgtgactttgggcaaatcactgcccctctctgagccttggttttcttatctataaagaataaataaaacttagggtaggaaagcactttataaaatgcaccagaaatatagaagattgtctttataaatttagaggagaaagtgactagaggctggtggtggctggtggtgatggtgagtggatggtgtgggtgggggcagcagcaatggtagtggtggtaatgacgataataatgatggtgatggtggtagtactgatgatggtgttggtggtggtgatgatgatgaagatgatgggggtgttgatggtggtagtggtggtagtggtgactgtgatgaggtggtgatggtggtgctggtgctggtggcgatggtgatagtggagtggaggtgagggtgatgatggtgctggtggcgatggtggtggtgatagtgatagtggtaatgataatgatgatgatggggcactgatgatggtggtggtgatggtggtggtgataatggtggtggtggtactaatgatagtggtagtggtggtgatgatgggtggtagtgatggtagtagtgatggcaggggagtgatgatggtggtcatggcagtggtgggggtgggagtggtgatgatgatgatatggtggtatggcgtaggtagtggtgatgatgatggtgatgatgatgatagtagtggtgtggtggtggtagctgtgttaatgtcaatattttgccatcactcccatttctcatatgccgggattggaaggagagtcacttgggccagacgaagtgtgtgccaagtgataaggcagtgaggggccttacttgagtctctttggcatcaggataaatacctcccactctgtggcctggaaacagttgagtatttaaaaacagaattttatgagccatcggggcctttccagaaatgcatctatatggatggggcccagcagaaatattcattccggacccacagcctcacccactgtatgtatgctctcggctggagagggcacgtcccagcaagtggcaccctgtcccaggggagacgcagcctcccgtctccctgcccctgtaccggatgcttcagcactgactcatctcgccttctgcaagggatcagtcagccattgccgccacctcagtgcactggaaaatgccaccaatcactgtgacatggcttccccattgcctgaccaagaccagcctggaaggagaggtgccccagaagtggaggagctgcttgtcacttctgacctggctgggaggcccacagagggcttcctctcactgagcctcagttcctttagctccaaaacgggataaataatcccttcctccaaacactggcgagaattgaacaaacatttatgtggaatgagaacacagcacatggcccgtggtgagggttgtagggattgttggtgttttattaccggaggagctggagactttgagattgcctagtgcagtccgatagaaatgaaatacaagccatatacaagccactccttttaaattttctagtagccacctttaaaaacagcaaaaagaaacaggtaacttcaattttaagggccagtgcagtgactcatgctggtagtcccagcactttaggcagccaaggtgggaggattgtttgagcctaaaagtgcaagaccagcctgggcaacatagtgagaacttgtttctataacaattaaattaaattaaattaaaaagttagctgggcgtggtggtgcatgcctgtagtcttggctactcgggaggctgaggtgggaggatcacttgagtcccagaggttgaggcttcagtgagctgagattgagccactgtgttccagcctgggcaacagagagagaccttgtctcaaatttaaaaaggaattaattttaataatatagtttatttagcccaatatatccaaatattatcatttcaaaatataatcaatataaaaatcattaataagatatttagcactctttttgtagtaagtctttgaaatccagtgtatagtatattttcatagcatactcaattcagatgtgaattttcattggaaatacctgatccgtgtttagattttcattgtatataaaatttcattggaaatacttgatctgtatttagatttcataaaatttacagttgacaatgtaggttcatatacccaagttactccaaacaagttttgtagcaacctaattgggtgtgtcaacttttaatttttttttttttttcttttgagacacagtctcactctgtcgcccaggctggagtgcggtggtgctcactgcaatctccacctcccaggttcaagaaattctcatgcctcggcactcccaggtagctggattacaggcgtgcactaccatacctggctaatttttgtatttttagtagagacagcattttgccatgttggccaggctggtcttgagctcctggcctcaagtgatccacccacctcagcctcccaaagtgctgggattacaggcatgagccaccgtgtccagccttaaatttaattttaaattaattaaagttaaataatattaagaattcagttcctcagtcatagtagccagatttcaagtgttcggtagctgtatgtggctggaggccacggggctagtcccatactagaggtggggaaactaaggttcagagaaagagcaggatttgtccaggggtacatgtagactcaggcactgggttgcaggcagtctgtgctgaggtccttcccgggccactgttcctgcctttctgaggaccgcagggtggtctgactggtgcatctctttgggatagcgtcatcttttctggcatcatagttgatgccgcattagtctttagagcagacatttctcccttgtgctgaatcaaagccagccgccccataattttcatgcgctggccaccctagagaacatggctggccctgcctccagaacagctgcagaaatctgcagacaggaaccaagtcctctgggttggtccagatgtttccttgttcctctaggacctcctcttcctgtccctcttctatcacaattagtcagtgcctcttcttaaagtacaatacctattcccaaatgggacatcacctccttcattctacatctggtgcctctgttaatgcaaccagagggattacatcaaagcagctccttagtgcttaccaagagcatagacattctttctagatcctttgaggcttgcagtcaagaagtcctttccaggccagaaacgctgcctgccccactccctccatcctgacctagtatggcccaggattgattctctctcttctctttctctctgtgtctgtctcttactgtcacattcacacttgcacacactcactcacccttgctgtgcagtttctctgacaactgtggacacaaagctggatttgccctcccagggcagggcagggcagatcaggccggaggatctctttgggaagccctgtggggcaggggcagagtggcctgtcagagggaatggcctggggactccaaggaaagtgggagaaggcagctgacctttccagcacaattccctactgtgaggaggctcctccagcccagtccctgagagaggaggggcccgttcaagggacatgcccacaggaattgctcgcaagtgacgcacaacatctcagagatagggaagaacctataaatcctctcctgccacctcatgtcatcagtggggaccatgagccaggggtggtaagagccctgggcatggagccagaacagctgggattgattcagggcctgcaaggcgcagctgggaccctgggcaaaagtcactgtatctttgggaacttggctgcctcaactggaagcgggtctcattggggcctaatgttcaaggtcgttgggagggtggaacagcacttggcgctggagagagctcagtgcagagagttgctccctgtaggacacccctggatgcctaacagtaaccatgacaacagcaaagccagcaattgcagaagccgcacccgccatccacccctgcacccaggcctcactgtcagcacgttcttacatcgccaggtcgaatccctaagttctgtgacactgtccccacttcacagcagaggatgctgagcctgggaaattaggtcaggctcaaggtcatgtgggtactgggtggcagaatcagtttcgaacctggccatctgcctccagagccgacagtctgaccgccttgcggatccgcctcagtttcctctcttctctcatctttctcttgctctgtccctcctctctcttcagggtcctgaaggaaaatcagggaagcaaggcgagaagggccgcactggagccaaggtaggtgtccccttctgacttgataggcctgcgtccctcccccgcatcccttccccacatccctcccctccctggaccctccgtcctgttgggcctggtgacagcttgtctttcctcctgttgcagggtgccaagggctatcaaggacagctgggtgagatgggcgtccctggagaccctggaccccctggcactccaggccctaaagggtcccggggcagcctgggaccaacggtgaggactctctggctggggtgggggagtcagatgtggaatagagggaaccaagggcaggaaaggagacaccaggcttctctgtgctgttatcacccaccccagctattagctgaacacctggtgctcattgccccagccacctctctgaatcatgaatcgctttggtaacctgcagaaagctgcagccccgcctccggaacagtatacaccacacagaatacttcctgcaatttgaaggggtgtgtgggtcccctgaagccctctatggacccaaattaataagccttgttattagcatcgggggagaaaggaccagattcttagaactgtttttatcaaacaaggagatttcccactggaaatagattcaggaggaatggagtgatgctgctgcaggtccctggatgactctgagggtgtcccagcattgctgggctgctctgaaggaaggggcccagagggctttgatacctccaggagatgaagaccccagggggaagccagggaaggaggctgaagagggtgacacagcagctccgatctggttgtgtgtaaggttaagcaaccaggctggtttgtggtatttgccagtttctgcggtgtaaatgctccctccatgtctggtttcaagccactgacatgacgtcactgaatgcagagtggggaggagttacacggcagccctcccttaggcagtatttccaccaacacgcacagatgcaatagaccaaaataacctcatgagtgtaggtaggaggaaaatgtagtaaaatggctaggaggagatgagttttgagtatcctctatctttgtttttaataacattaatttaactgtaagtccataaaattgaattgttaataacggctctgtttcactggcttgtaaaagtcctgaaaatttagcaatcagctgtctcgaacccctggagccaggagaaggagggctggggcaggggtggggaactccagggaggagggataatgttactggctttccgccttgttcacacactttggttatgggcggcatggatgtgccaggctgctgggcggagcggggctggagcctgcagggagactgctgtgtccccgctgtgagagccacactccataccaacgagggtctcctcctcttgtagggtgctccgggacgcatgggggcccaaggagaaccgggactggctggttatgatgtaagcagatatcacctcaccccaccccccgactctgtcctgcaggcctggaaacacaggcccatgccagcctctgccccaccacctcccagctgaaggctgacccctggaatactgaagatgtggggtctcacctgccccagggagcgctgggcccagagccgtggttggggtggaggatcatggatgggacaggtgtggttggggctgccagagcgaaatgtgccaccccaagccttcttgggtatttcctgcccagggtgggcgctctgcatgccttgtctgctgtctggggaagggaccatttctgcatccaggttggcaccttcttagacatggctgagccaaacccatgttacacatctggagaaaccagggctcagagagatatggtgcctactcagaaggggaaaccagggctcaggaggataaagagcatgcacgaggcctgaccacttcagtttggaggtgggatcctagccctggtccttgtggctctagatccagtgtctggaagaaatgcagcagggaagggaggaggaggagaggaaaagaggcgagacaagacctggaggggtgttgcgaggagcccacagtgggtgtccatacctgcaggcctagccaaagcctgggaaggtctgttgaggcaagcattttgcccctgtccctggttctggctgggagaacaaagctggttctcccgagtcacccttccaggtctgctccagggtggggcccccaaccatcccagctggaacacccctttggggtgtgtctgggaccagcacggcacatctggaaggccagggcccagacaggcacagacttactcagagccacacagccagctggggcagagctgggacccagttttgcagcccagtatccccatcttggagtccatgtcctttgtccttcctgagtcctcattctcacttccctccttcttgtttgcctgcagggacacaaaggcattgtgggaccccttggacctcctggaccaaaaggcgaaaaggtgggtgtttgctctggggaaagcagctgcaccctcgtgtctgaggctgaggtcagcttcagggccagcaggagaaagcccctggggtacccatggctggagaagcctgtgggggctcaccccctgcagcagccgaggctggtgtcactgccactgtgcccagcccgcaggagctgtcagatccacattcagcactatgtgctgggtatcatctttgtacccagcgctggaacgaaaacatgcaatccctgccctcacggggcttatagtcaagaagcagaaatggacatcaatcttgtaatgactaaaactgcgactccatcatctgtgtggacatgggaattgaagtcttgcccatgaataagatcacccagtgaagagtggggagaggatgctgagcaggagaggcttgggacagagagcaaggaaccccagtggttagtggtcaaggaaggagccaccaaggcagaggggaaggcatgttcattccccacgccttggctcaagattcagtagaggagaggaattgctggaaggatcctcgctgatccctggaccctgcccccccatgccagtggggatgtggagggccaggagtgccagaaggtccaaggtgttggtgtggtgtcacgtccaaggcaatcccaaactggccccagaacccacgtgtctaagtcctaccttcgtcgcctgagtccctcctgtctttcctcctcctcccctcccctgctggctcagctggaacgcttcgcttgccccctgcctccccagcacgcctttcttttgctgagtcagctccccactaactaaatcctgctgttggtgactcacgctggcccggcgtgctgcccagccgaccccttcctcctgctggaggaggacagctcagccatggtagacggccacccgccccagccgattccacaggaagccacagaaggtgccactcagtaccccgggtccctcctgggccctcgcagcctgccagggctggcacagaaggggttaacacagactctgaaacaaggaggccctggtgtgccccaaggcctctgcgccggagcatctgcagctctagaagcagtctctgtggctgctgagaatgggaccctaacaccaaatctgccctaaggctgcaggggccttgtgggggtccccaggattccctgagccttgagtgcctcatcaagtggtggggtccttgggaatgagaggtcaaggtgggggcagaacatgttcatcagccagatgccttttctcacttagaaggcattattagattcgttcattcctccagctctccaacaggtacttatggaggatttagtgtgttccaggccctgagctagaggatggaaatgatgcccttagaggtctcaaaaatagggcgagtcccatgaatgaacagccaccccgcaagctggacggtgctagggaggagagagcagcttcctggggtgacccattgagcacacgcccacgtgcagagttctttccctgccattcctcctgtaatcttcaccacagccccagtgcagaggtaccattgttctacaagacaggcggggaaactgagtccccataaggctcagagactagcccaggatctgtagtaagagggtggcagggccaggatttagaccccatctgtccgatgccagaccctgcttccctaaccaaaagcagacccaagataaggaagccatatgcaatttaacttgaaccgcccatccctgctcaccgtgggggtgagctcactacaaagctggtggccagagagaggggatgagactctgggacttggacagggcagggaagtatcctaccagatttctggtgctaaaaaatgatatacctaatgctaaatgacgagttaatgggtgcagcacagcaacatggcacatgtatacatatgtaacaaacctgcacgttgtgcacatgtaccctaaaacttaaagtataataataatagaattaaaaaaaaatgcatccccagactacagtcacattgcgggggatcagtatagctggctttgggccgagattgccccctgattcctgagtggccttggctaagaccttccttcctctcagtttcccatctttaagtgtggacagtagtcccagcggcatagttactgtgcagatcggatgaaacaaacctcacagagtgcctggcacatggaacacgctaggtagacacaggcaggccccttccccaaagccgtcaagtccagctgcctctatccacagtgggacttgagcactggatccaagaaccatagagagtgggcagggtcaagaaggaatccccgctccttgggccacccctctagacctcaggccaagtccctgccagccttcagcctccacccaccagaaccacagaggcccaggctggtggctgatcaccaccagcctttagaactgcctcccaccagggatgtgtcccagccccagggacgctttgcctctgtccagcctcttccggccccctttcaatccctatgaacaaaggggctcaggggtgcctggcttgagccctgtgcccaggggagtgacaccagtttctggggctggagtcttctgagccctgagattctgccatttgccgttccgcttacaccttccttgtagttgaaaggtggcgtctacacctgtcctgtgggtggaccagggcctggggtggccatggcataaggacctcacctctaaactctgttccgccccccccaccccagtctctggccatgtctatatgacacagtctcactgctgctattgttaccggctacggcaattttaacgccatctgctgagcccctgccacgtgtgcagcagcctgctgagtgcttcctgtgcctttcctcaccgagtcccctgaacagcaccgggaggcgctccagtcccgctctgcacataggaacctgtcttatggacacagcccccatgctgactggctgccaagtgccacctggggctaccatggagggtaggaggttcatcctaaagctggttcctcccagcaaggatcggagacagggactctcgggttgagggtgaaaactctgagcaggtcccatcatctctccgagcctcatctgtgaattgggataataatcgcatctgcttcacagcactgcactgcggatgtcatgagtctgcctgtgactggcccagagcagtgcccatgcgtgccagctgctggagttggtgttactccctgccgggcgtcgcgcatcattccacggagtcctcaccactccttgatgggcatcacatgctgtccccttcaccccaccccactccgctctgttctcctattccccagcagaggagagagctccgagacaggaagggaagtgttgcaggccacacggctggtcctttgcaagccgggatgtgaatccagctgtctgagctccctgacttcctgcaggatcctacagctcaagggcgtctggagggcacaaagcactgttctgtgttccacagtcctggttccacaccagcctgagtctggctcagacacacctacccttccctctctagtttgtgtccccatctgtaaccctaagcaggctagaattcatctctgacgaagcgctttccgtctggaattccccacattccccaggagcaggcggtttgccctaaagctggttctgtgtccacagggggagcagggcgaggacggcaaggctgaggggccccctgggccacctggagatcgggtaagccccctccctcccctggaccatgtggcgtcctaggtggaatctgagcctcccgctgcatggagaggggtgggccgatcaggggccaggtccctgagagctccgcagaggtcgcggccaacagggcccagggctggcatccttggcacctggtggcccaaattttgctgttgtctttgtcattcagggccctgtgggtgatcgaggagaccgcggggaaccgggagaccctgggtaccctgtaagtatcagagctcctacctgctggcaggatcgggcatgtcagggagaggggggatgacacatgtctagaaagaacaagaacttcccaggcttctgtgctgcctcccagccctctgcaggatgggcccccctcacctgtctctctttggcttccagggacaggagggtgtgcaaggcctccgtggaaagccaggccagcagggccaacccgtgagtggtgcttcgtgtcccatccctgcctcccaccctgagtggggcggagcagtgggaattaaagaactaggccctttaaagcttaaagggaccctccctgcaggagggtctggggcagccatttctgtttctcctgccctgaccctggggatgcccccagaacctgcacccccaaacccctccccacccctccccctccaggcggagactggccaccctccccgggagagaatcctggggctgccttgcgtcatctcaccttggtttgcaggggcatccgggaccccgggggtggccgggacccaaaggatcgaaaggcgcagaggtaagagggccgggggttcagcagggagactgagtcccaggaagggggaagcctgacccacagtcacacagcaaaccaaacgcaggctgcagaggctgcgaggcagggtagggaggggcggcccaccaggagcccggcaggctgcttctggccatgaccccatctcccttcaaatagcctgagtgaggagggacaatcagccccatttcactggggctccaggaggggagccaactgcctgaggccaaccagagtgacttgaacccagggctcaccacactgtagagagaaaactgggagaagtcaattgagggggtctggaggaagaggaggcagagacagggtgcttgagcaggagccacttcctgcctctgccccagggcccctgccttcccccagcccccagactgggccagtgctctcttaatgctctttccctcccccgggtgcgcccccctcacctgcctgcctcggtgatacctagtctctaaaagatccagtggaactgtggcctctggctcctcccagaaaattgtcaatgccagtgaggggacaccaaggcccagagcaggctcagtgacagccccaggaggttccaaggccagctctggccccaggcttccaggccagagtgcttgggtacatctgtggcatcagatgttcacccaggggcccacaatcctctcagtccctccttccagagcccctagggtcccacacctctaccaggcagcctccatcatgtggcccttgatttttcagggaccaaagggaaagcaaggcaaggcaggggccccaggccggaggggggtccaggtgagtgactacagctgctgtttccagccaacctccctgcccgccccccacacccgccctcctcccactccctgcaccaaatgccctcaccagctttttatgtaccccccagggcctgcaggggctgccagggccccggggcgtggtggggagacagggcctcgagggcatcgctggaccagatgggcttcctggcagggacgggcaagcaggacagcaggtgagcgggaattggcattaacagatggtggctccatttgggaccaggtgtaggggaacttccccaggccatgggccagaggagcccgtttggaaacttggatgggcagaaccaacacatccagaagttctctggggtgggcaaccatctcctcccctggcacctgggagtgtggaccttctgactgtctctcctggatgccagcacccagaaagaccttcctttcctcccctgcctggtggatagggttcctctcccgccccttcctcactcagaatcccgcccttccccactcacaatcctcagctcctcctgtcctcctggtccagccacatcacacacaggccgtctgacctccatcctggagtgtgaccccttcctccagcttcacccagggtttgcccaggcgttgagccatctgcttccttggctgtatcgtgaaacacaagagaccctcctctgcctgctttcttaacagggggagcagggagacgatggggaccctggccccatgggccctgctgggaagagaggaaatccaggtgtggccggcttacctggagcacagggacccccaggattcaaggtcagatacctcttaatacacttacccaccctctgccctttctgccttgatgcagactctagtggttccgaccctttgggcacccatgtcccagggcctgtgtgaaaatggagtccacattgttgacctttctccgtcagcagtgcttgggggtcctgccccaagcttgaaccagaatgatagttcatctggggagctgtaaatatcgcccctaccaggcccttgaaaccttcaactggtttttgagttgtccacgggcgccctctcgtggacatttgtggaacaacacgttgcttgcagccgggatccccaaggcatccttagaaagcttcccagtgccgcgtgggaggagggggcccccatgaatccgtcagagccaagggctggacactgaaggggagatgtagatgaatgactcagatgtggttcttgccctctctgagctcgaggtttaattgggggaaagattggaaccctctgagacacaggaggcggagggagcgatggccttgacccagggaagatgtgaatgagaatagaaggggaaaaggtggccacacagtggctcacacctgtaatcccagcattttggaggctgaggctggcgaatcacttgaggtcaggagttcgagaccagcccggccaacatggggaaaccccgtctctactaaaaatacaaaaattagctgggcatggtggcaggcacctgtagtcccagccactcgggaggccgaggcaggagaatcgcttgaattggggaggcagaggttgcagtgagttgagatcgcaccactgcactccagcctgggcggcagagcgagactctgtctaaaaaaataaaaataaataaataaatggggaggaggcattctacgagtgtgagctgaggtttgaaggagggaactgcatgctgttggggaaaagcaataaggaggagaggaattgtgggagaggagaggggaaggcagggcccggaatgcgagaggagagacagagaccttcctctttgggaggtgaaagtcttgtcacccctaccccaccaggcctccatttgttgccccagcattctgcaatctcgggtaccctgtggaatcactgttctggctctcccaggccccctccgcctcctcctgccttagaaccccttcccactttgactggtaattttttgtgtgtttctttaagggtgagagtgggttacccggacagctgggtccccctggcaagcgaggaacagagggcagaacggggctccctggaaaccagggggagcctgggtccaaaggccagccggtgagtgagcgccaaagaatacacatgcccacgcactcacacatgcacacactcacatacacctacatgtacaaacacatgcacactcatacacacacacaaacacactgacccagaagccacctccttgctctgtgacaaggtataaaatctgggtaccagataccattctgccacccctcaaccaggtggtgggggaggctgaggaaagagacctgagtggttccttcagaatgaggagagggtgatcacaaccagaaggtgggcgctcctgactcccagtccagtgctcattctgtgcctcactgccttcatccccctgtcccagaggctgcattcaactcacccttgcctggaaaaagaaggaagaatgaacagagaataaacagggcaaatagaaaacacacaacaaacagtttcaataccccaattaaagctgagattgtcagagtggatgaaaaagcaagacccaactacatctgctgctacaagaaatccacttcaaatataaagatataagtaggttaaagatagatatagaaaaagacatactgtgctaacattcatcccaaacagctggagtagctattttaatatcagatgaaatgaatttcagagcaaagactactaacagtcataaagaaggtattttcataatgacaaagaagccaacttttcaaaatagcataagaatcataaatgtttatgcacctaaaaatagatcttcaaaataatcaggcaaagactgataaagctacaaggagaaatagacaaattcacaattatactcaaggatttcaatatatttctctcctaatgggtagaacagaagcaaacagaagatcagtaaggatgtcttgaactgcattatcaaccaacatgacctaattgacatttatagaacaccacatccaatatcagcaagatacacattcgttataagttcattcagaacatttaccaagacagacactattttgagccttaaaatcaatcaataaattaaattataaatcaataacagagagatctgaaagatctccaaacatctggaaactaagtaacaaatgtctaaatgacccatgggtcaaagaagagaccaaaagagatgttagtattttgaattgaatgaaagtaaaaaacagcatataaaaattggtgaaatgctgttgatatatagggagatctttatagtaataacttctgtgttagaaaagaagacaggtctcaaataaatggtctcggattccgtcttaagaaactgggggttggggctggagaaggcaaatttaaaacaaagtgagcagagggaaggaaataatgaaaatcaaaaataaaccaaaaaaaaaaaaaggaaaatcaaaagttagctttttgagatctgtaaaactgataaacctcttgccagactaatcaggaaacaacaaaaacaacaaaaaggatacagaagttactagtatcagggataggggagcaatgtcactacagatatgacagaaattaaaaggctaataagggaatattataaatgattttatgacaataaatttaaagacttagatgaaatggacaaattccttgaaagacaaaactaccaaaggtcatcaagaagagactgataacctaaatagccttatatctattaaagaaattgaatctgtagttagagcttcccacaaaggaaactctgggcccagatggcttcactggtaaatgctactaaacatttacaaaagaaataataacggctgggcgcggtggcttacgcctgtaatcccaacactttgggaggccgaggtgggtggatcacgaggtcaagagtttgagaccagcctggccaaaatggtgaaaccccatctctactaacaatacaaaaaaaaaaaaaaaattagccaggcgtggtggcgcacacctgtaatcccagctactcaggaggctgaggcaggagaatcgcttgaacctgggaggcggaggttgcagtgagccaagatcgtgccattgcactccagcctgggcgacagggagagactctgtctcaaaaaaaaaaaaaaaaaaaaaagaaggaataccaattctacataacttttccagaacattgaagaggagaagaataattcccaactctttccttgaggctgattctaccctgatgtcaaagccacaccaagatattacaagaaaaggaaacaatacaccaatatgcttcataaatatagctaccacagttctcaataaaattttagttagaggaacctaagaatatataataaggataatacatcaagaccaagtggagtttatcttaggaacacaaggatggtataacatttgaaaataaatcagtataattcactatattaacagactcaaaaaagaaaacccatttgatcatctcagtagttgcaggaaaagcatttgagaaaaatctaactccacttctgataaactctcaacaaactaggtatagaagttcctcaacttgataaaggacatccatgaaaaacctagtcaacatcatacttagtagtgattgactgaatgcttttttccaaggagcagagcagaaacaagtcaaggatatctgttctcaccacttctattcaacattgtactggcaattctagccagtgcaataaggcaagaaaaacaaataggaggtattcatatcaaaaaggaagaattaaaacttttcatttgtagaggaaataatgtctatgtagaagatccattggcatccacaagaaagctactagaataagtgagtttaacaaggtcacaagacaccatatcaatatgcacaaatgaattgtgattgtatatactaggcaatatgcataaatgaattgcatttctatacactaatcaatgagcacaaatgaattgcatttctatacactaatcaatgtgcacaaatgaattgcatttctatacactagcaacaaacaattagaaatggaaatctaaaaagcaatactacttataatagcataaaaacatgaaatacttagagatacatctgacattaagtgtgcaacatatgtacactgagaactatagaacactggtaagagaaattgaggaagacttaaataaatggagatatatactgtgtgcatatttcaaaagactcaatattaagatgtcaaatttcttcaaattggtgtattgattcaacacaattccaatgtaaagcttatcgggttttcatgtagaaaatgacaagttggtcctaatatacatatgaaatataaaggacttagaataactaaaacaacattgaaagagaagagcaaagttggcagactaatggcacttgatttcaagacttattacaaatctgcagtcatcacgaaactgtggtattgccgtaaataactaacagatcaaaggaacagaatgaaaggtccagacatataccatacatatacggacaactggtttttttttgtttttttgttttttttgagatggagtttcactcttgttgcccaggctggagtgcaatggtgcaatctcagctcaccgcaacctccgcctccaggattcaagtgattctcctgcttcagcctccccagtagctgggatgcaccacgatgcccggctaattttgtatttttagtagagatggggtttctctatgttggtcaggctggtcttgaattcccaacctcaggtgatccaccacctcggcctcccaaagtgctgggattacaggcatcagccaccacacccggcctggacaactgatttttaacaaaagtgcaaagacgattcagcaaatacaaaatagtctttcctaacaaatggtgccagacaagtgatgcctcataacatgtacaaaaattagctcaacctggatcatacacctaaatgtaaaactgaaaattaaaacacttctagaacatagaaggacatcttcaagaacttggataagacaaagatttcttagatatggtaccaaaagcatgacccagaaaagaaaatgtgataaatcagacttcatcaacatttaaaacttttgctcttcaaaggacactattaagagaatgaaaagacaagccacatactggaagaaaatatttctaaatcatgtatctgattaaggatttgtatccggaacctaaaaagaactcgcaaaactcaataataaaaataagcagcccaatttttttaaatgggcagaagatttgaatagacacttcaaagaaagtatactgatagcaaataagcacatgagaaaaagattaatatcattagtcattagacaaatgctcattcaaaccacaataagatgctatggcatacctattaaaatagtgaagagttttaaaagactaaccataccaagtgttggcaaagacatggggaaactgaaactttcaaatgctgataatgggaatttaaagtggtacaatcactatggaatcagttgggcagcttctttgaaagttaagcatatccctattgtataatcaaatcattccactcatagatatttaccctacataaataaggacattcagccacatgaagactatacttgaaggtgcttagcagctttatttataatagccccaaattgaaaaaaacctcaaatgtgtatcagccggtgaatagataaagtgtggtatattttgcaatgaaatacaattcatcagtaaatggattgaactattaatatatgcaacaacataagatgattctcaaaataattaggctgagtgaaagaactcagataaaaaatagtatagactgtgtgatttcatttatataaaattatagaaaatgcaaactaatctgcattgaaagaagatagatcaatggctcctggagatgggagggtaggcaggaaagaaagattacaaaagggtgtgaggaaagtttctggggctatgggatgttattgtcttggttgttgtgacaattacaagggtgaatacagacagatatgtcaaaacaaatcagattatacaatttaaatagtatagttattatcttcagttttactttagtaagactgtttttaaaattaccccttctttgcacctgatgggtgtataggagacagccatcagagtgcaaaaatgaacagttaggacatcacgcaactggttctgtgaagccagtattatcctgataccccaaccagaaaaagatgtcacaagaaagaaatcaacagacaaatatgccttatgaatacagatacaaaaatctttaataaaatattagaaaaccaaattcagcaatatgcctaaaggagtctacaccatgacaaagtgagatttatcctagaaatgcaaagctggttcaactgttggaaatcaatcaatgtaatacaccatattaataaaataaaggacaaacattatagagtcatctcaatagatgcagaaaaagcatttgacgaaatccaacaccctttcgtgatgaaaacacaacaaactaggaacagaagggaacatcctcaacctgatagagaatatctgtgaaaatcccacaggtatcatcatatttaatggtagaggactgaacacttcccccaagatcaggagcaagccaaggatgtccactgttaccacttctattcaatattatactgaacaaaattagtagaactaataaaccaaagttgcaggatataagatcaatatacaaaaaatgtcatttctatatataacatacaaacatcaattatatgtctatacactagcaatgaacaattcaaaaatgaaattaataagacatttccatttataatagcatcaaagagaataaaataggaagaaatctaacaaaagaagtgcaagaagctgggcatggtggcatgtgcctatagtcctagctactcaggaggctgaaatgggagaatctcttgagcccaggagttcaagtccagcctgggcaacatctcaagaccccatcttaaaaaaaaaaaaaaaagtacaagatatgttcagtgaaaatttcaaaatgttgatgaaataaaagaaaacctaaataaatggaaagacatctcatattcataggtcagaagactttgtgtggttaagatggctatacttaccacaaacagagctacagattaaatataatccctatcaaaatccaagctgactttttaacgaaatctgacaaattgatcctaaaattcatatggaaatgcaagtggcccagaatagccaaaattttgatctttaaagaagatcaaagttggacaactcacacttcccaatttcaaaacttattacaaaagtatagtaatcaagacagaaataaaaccttacatttatgtctgttgtttttagcaagagtgctagggcaattgaatgggaaaagaattttttttcaataaacagtgctgagacaatcacacaatcacatatcacgtaccagagaagtaatttggacctctgcttcacaccacatgcaaaaattagctaaaaatgaagtatagaccaatgtaaaggctaaaactgtacaactgttagaaaacataaaaacacatttttataaccttgtgttaggtaatagtttcttagatatgacaccaacaaaagcgaagtacatagattggacttcatcaaaatcaaacacttttgtgcttccaaaggcaccatcaagaaagtgaaaaaactcacagtaggggagaaagtatttacgaatcatatctctgataaggaacatgtatctctaatatataaagaacccttacaactcaagaataaaaagacaatccaaatttaaaacggacaaagtattcaagtagacattttttccaaaggagatacacaaatatccaataagcattgataagacaaatgaaaaccaccaagagaaccaccaatagctcaataaagctattatcttttaaaaatgaacaggtagaatttagattaaatgggaccctcccgaagcctgacccctcagcctacctccatcagcactgggtcttgacctgcctggtctcattgcatccttccagccccttgggagggagatgacgtattatcctattttacagatgaggaaactgaggctcagtaaagggaggtgacttgctcctggtcttataatataaggctaggagattctaatacatggctttctgcttatgagcttgaaggccaagccccaagaatgtgtaataatggcaggctcttctgcctccaggggcccccagccctcccttcttggctcagaccccagcatgcccccttgccaattgctctcctaaccctttacaagattgggagcagaggtcaggaaaggaggccaaaggttcctggaatcgttcacactgggtttgaatctagcacagtccacaacatggtgtctgcgtgacttttagcaagttcctgccctctctgagcctgtttcctcatctgtaaacaggggatatggtgtgtccctgggttgatgtgggagcatggaagtgtggcggtccaggcaaaacatccggcacctaacaggccctcagtgaactgggttatttttagtttttaggggaatccttccttaacagagcttttcagagctgtgggaggaggctgcaggcccttttattctgtcccttgaagacctgggacaggagctcctgagtgtggcagagcctcctctgtggaatccctgagccgggctcctctttctcatctgacggagagcacaggctcccctcagagcccaggcggactggcatctagtttgtgagctgttcacactcacttggtcgcttcacagaggagtcactgatatccctggaaaggctgggagggaaaaggcaggccctgaggtcccaggtggctggcgggacacgctgaccatgagctcactcgctccatcacttcctgttcttcctgcagggcgactctggcgagatgggcttcccaggaatggcaggtctcttcggacccaaggtatggactcccacggctcactgttcctgtggggtcccatccattcaccccattcattcatttattcattcaacaaatatttatggagcactgaaaacattggctggaaaacagccagaatcaggcatgaacaccctcatcccccagtactccagaagatctaggttccaagcccagctacacaattacctgctctgtgccttgcaaagtcacttagtctctctaagccttggtttcctcatctgtaaaatgggagcaatgacagtagaagactgttgcaaaaataaagaccaggggcatatgccacacagcactgagccaacacactgctggtacctgctgaataattgtaggtgtttcttactccttctggggcctctcaggtaaggcctctcttgacaagaagggcaaaggttgacagaccccaggggtgagggagctgtgggggccctttacccagtggctgccaagtacagacagccctttctctgcctcccacagggcccgcctggagacattggcttcaaaggcatccagggccctcgggggccacctggcttgatggtgagttccctccctgctgtcggagcagagatgattgtcctaggcccaaggttggccagccatcagctggcctgtcttcatcctcctcttgctccttgactcatgagccctttctgcccacaggcctggttcccaccttcactcctgccgttcccaccagctcagcccccatccttccccgctttcactcttgcccccatcgccccactcttgaagtccacccctaggcacaaatgaggggctcaggagatgcatggcctgggcccgcttcagatggtctcccttctactcccttgcgacgctcgggctgccctccaccccgctccccgtgtctgttccccaggccctggaacaaggacacatgagcctttctgtctcctttagggaaaggaaggcatcgtcgggcccctcggaatcctgggaccttcgggactcccggtatgtgtggggattggacaggaagactccggggtccccttgccttcctggctccagattgtctctgtgactcagtgccagtctgagcctcagtttcctcatctggaaatggggcttcacctctgggccctgtctcactgggccgtggtttgttgcagggtccgaagggtgacaaaggcagccgtggggactgggtaagtggatgggctggggctgagggatgcagcactgcaggggcgggggaggggtgggctcccagagttgggccatggctcagccaggttccctaactctctcccctgcttctgtctccctccagggattgcaaggtccgagggtgagtgggctgggcatgagggctgtggggcggggcgtggggcgggcaccctgcattctcctcccggtggtacattctctccctccggacctccgtcatcccgtctgtgccagaggaaccattgtccctgggtcccaggtctgcttgaggagggactgggttggggagagatgaagaccctgtggaccagggctcactcttcttctcttgttcccccagggtcctcccggccccagagggcggcccggccccccggtaggtaactgagtgctgggtgcatcttggactcctggggggttcctttgaaggagattcaaggcttcaccggcagactaagccttgaccctgaaccccacaggggttcttgtagcccacagactcctaggagagtatagggcatcccccgaacattcacttttgcctacgtggggtaacacctaggggccaggcctccagaaaagcatagaccagcccactggggcccaccaagcctccgggaaagcagaggccagcttggcaggtcctgcatgctttgatggtctccctggtctcctgacaccctctcagattccagcacactgtccctgtcatttgactgacccgcagtcttcttttgcagggtcctccagggggtcctatccaattggtaagttggaaaccttctcttttgcctacttggggtaaggcctgaggggtttgggggaagaggctgctggccctctctggccctggtggctagagccctaagctgggtctagggacgcccatgtccttttgtcacttcatactggagacttggacccggaagcaacagaacgagccctgggccaggaggcaggaaacctaagtttttgagttgcctctgactgaatccgggaagatgctccagccaccgggttcatggccctatctgtgtactccatacacgtgggctgattgcaagggtctgtacatctcagattctgaatccaaagagagttggggccgggcgcagtggctcatgcctgtaatcccagcactttgggagttcgaggcgagcagatcacctgaggtcaggagttcgagaccaacctgaccaacatggtgaaaccctgtctctactaaaaatacttaagtagttgggtgtggtgggtggcacctgtaatcccagctacaggagaggttgaacccgggaggaggaggctgcagtgagccaagatcgagccactgcactccagcctgggaaacagaccaagactctgtctcaaaaagaaacaaaaaaaacaaaaaaaaaaaaaaacaaagagagtcgggccaggggggcagattggggcccctgcattcttccctattggccactgtggccctatctgagagcatgactcctcccaagccctatgacgagtccatccacattgtactattgcacggtggctacacgactattaccatcaggccccaacagcatcccagggcacagcctcgaggaaagactgaatgggccaggagcccttgagccatgcgtcattcagaacctctgctctcctcatgcctgctctcactgccactccctctgcaccatcctcaaagacagagtgacagccctggcctctcctctgcagccttcccttgtccttctcatcagtaagaaaggcagggaaaggaaagtgaaaagatccaggaaaaacagaaaattagaggattttgcatttttttgaataatcactactaatgctaattgagtgcttgctcaatgccagacaccattacaggtgctttgcttttctttttttttcttttcttttttttttttttgagacacagtcttgctctgtctcccaggctggagtgcagtggcacgatctcatctcactgcaacctcctcctcccaggttcaagcaattctcctgcctcagcctcctgaatagctgggattataggcgcgaaccaccacgcacagctaatttttgtatttttagtagagatgggttttcaccatgttggccaggctggttttgaactcctgacctcaagccatacacccgcctcggcctcccaaagtgctgggattacaggggtgagccaccgtggccgggctacaggtgcttttcatgtattcactcatgtgttcctttcagcagttcttgtgaggaagttttattatcaggtccattttcaagatgaaagaactgagaaagagttaagcagctttccccagattatgcagttagtaagtggcaggtctggaatttgaccctgaggagtagccccagagtcccccgttctggaccccaggcctcagcttttgctgttttcatggcaagaccacggctatgtctctgccaagcccagtggtagggttgggagtgcaaagttatattagactattaaagtgcgagccaaaggagaaacacggggactgggggcatagagaaagggggcctccctcatcttagcctggagtcagaagcttcgggagaggcttcccatcacaactgacatctataggatgagtctagggcaggttttctgagacacagtgcaactgacatttgcataattctttgctgtgagtgactgtcctggaggatgtttagcagaattcctggcctctaaccaccagatacaagtagtaccccctcccccggcttgaacaactaaactgtctccagatattgccaaatatcccctggggggcattgtcgcctctccttgagaaccactggtataggagatagccagatggtgcattgaagggagggagaggtcctccaggcaatgagaacagcatgtgcaaaggccccatggccagatggatcatggcgtttaggaacttagaagtactatagtgcggctggtgccagagcacatatgagggagaggaaggagacatggctcaagaccacagtgttcaaactgggtcttataaccatgttgaggagtctgaacttaatcctgagggccatggggagctattagtacctggggaaagggaatggcagggtcagctttgactgtctgcaaagagaggaaggaccgagagttctgcagagggcatatgacttggccaagatcctgccagggaatgtggccctggggctcccacttgatgggtgtggagaaccctggggggccacgatacataccctgtcttttccttgcccagcaacaagatgatcttggggcagctttccagacgtggatggacaccagtggagcactcaggccagaggtatctccaggggctctccccatgtgggatcccttcctgggagaaacgcaaatagataatggcccacatgtggtcagtgccttccatgtggcctgcatggagcatttcagagtcctggtcttggtggcatctcgcatccacaaatgggggtttgtactgaaactcagaatgggcagtgagtccaaggtcccatggccagtgcaggcagagcaaggccagaaacaggccctgaacccttgagctttctccggaggcctctcagagtctccaagctcttgctggctggagtcagggggagaagcttgcctgggcccagagcccgcagcagcttcccagtgctcatccccacgtttcttcaggagtaagaagctcatggttagctcgtggggctctgctaagaacctgccctgtggttaactcagctgtaagactccaggctgagaagggagtcccatgtcctctagtccagcctcggtcaggagccccctttgcagccttgcctccttcacatgacagggaacttactgcccccagctcaaacctcctatgaacatttcggtttgttccctgtgctggatgctgagacagatggatggccagtcacagccttgactttcagagggctcacagtctagggtggaggacagcatggatgagccccttaccatctgtccggggaggtcagtggaaagagaggggaacactcaggatccagtgcggctggagaagggaagcgtttccttccatccctagaagccagtgatgccgcacaggagagcgctgacctgcaacatccttaacatgatgaaggaaagtggctccgtttatcaagcacctcctacccactctgcattggcggtagaatagaggcttatttctcgtgcacgtaaaagttaattggcttgttgatgagagaccttggctacctgccaggggctctgccctcttcctctcccacacgtggctcccaaggtcactccacaccagggggaggcaccaccggggaaagagagtgtagagaattgtgcaggagggtctctgggccaggcctctatggggctagcatcgctccacttccatcccgttggctagagcacaaataaggctgaagatgtagtctgtccaggcagaagaaatggattgggtgagcggctgctggtctctgacacacgttcacacatgcgtgcacacacacacgtgacctccgccacccccagtggaaggagggtttatttagctctgatttgtagctctggaagctgaggcttaagggagaattctggccagggtaaccctgaatggccggctgtttagcatctgtggtcccctcctgccccctagtggagatctgctccttctctgagctgaagtcctcctcccagcacttgtgcctgctggccccagtcccgtctcctggtgcctcacagagaccctggctcccaccctaggggagcccagtgggggctgtgtgacccccaagtcagctccccccagcacctccccttcctccacaggctctttgcagatagagattgggccgctgccgagtgtcccacgcaccctcgcctacctcattcacggggctctgcctgtcccatatcagagaacatggtctgaccctgagctcttttcaagcctctgagccattgtgatagcctctcctcctgcactttgtccctggcccgttttcttgtctgcaaaataaagagaaacccaacccgtgctctagccatgaccgtggaaccgagatacctcccaggttgtgagaactgggggctgtggaggcttgaaccccaggctggaccaggaccctaaggtcccaatgaccaccctctcctcgtgacagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtgagaaggcttcctgccgggggtgggtgcgcctggcggtggggagctggggcaggtggagtatttgatttccgccgcattttggctgagtttttgtcctcagcaagacagatacactggcagtcatttattcactcagcagtcacagagcctcacaatataccaagatccgcatgctggggatgaccatttcagtgcaaagagacaagagctctggcagaaaaagctcctgaggctgtaagagtccccacccctggggcccatcctgtcacaggctcccgggtgagccaggattttccccctttctgagcatgaggactctgctctctcatctgtgagctgatgtggtgctgtgaaggacaagctgcggagccagacagacctgagttccaatgtcagttctgcctcagacttggtctgtgagctggggcaagccacggccccatcccgagctgcccttgcctcctctgcacaagcggctgggactagatggctggttgttccactcttgagctgcaaaggttttggcttcctgagaagcccagtggggaagctagatgtaagcagcagcgctggctgatggggtgggagacctgactcctaccctcccccggcaggccctaggaggagccctaggcctcgaagaatccattcaactaggtgatcccccaaacccttgtgcaagtgacccagcctctctcaatgtcagttgtcttctctgtaaaatggatacatcccagtagcaacataggcaagtacttagccatgtgacccctcctctgggggctctgccagttgtgagctctgcccagaaggtttccttccatctcggttggaggaatcccttttctgctcacccaccctgacttcatgctcacctggggctcggcaggtcacaagatgcagggtccatctacagaaccaaggaatgggctcatcccccagatacatacatcacctccatcccacgctgcctgcaggtacctactgggtggatccaaaccttggctgctcctctgacaccatcgaggtctcctgcaacttcactcatggtggacagacgtgtctcaagcccatcacggcctccaaggtacccatcagctcccacactgcccaccaggctgtctgcctctatccccagcctgccctgggccacaaccaacccaggttctgttctgagctgtgcctgtcttactgcatgcccttgggaaagttatcgcctccttccgagactcagtttccttatctataaattgggagtgagtaggactaatttgtaaccacaaaccctttcgagtcatatgatgctgatgattctttcttcaaatagaatcttctgcctaatatctaaagcagagcagttggccaagctggcctggcttgtggaactatgaatcatcagcatgaaataaaagagaaaactagcatgatgctcatctgaagcatgttgtgtgaattatgtatgcgaatacttaactcatgttcaatgcctgcgtaccacgtgcctgtttctgggttgagcattttaggtggtacagggccactcaacaacaaaccaaggcaggtggcagcatgagacctgacagctccctcgcccagggatcctcagtggattgtgggtctgtagttccactaagccttccgaatttgggggcaatttatgccacagtgagaagctgctccgactgcgggggaaaggaaccctcccatttcatcagccacatcccctaggagatgccttgtgctgactgggtcagactggcagtttgagaatctctaggagaggcagccagccagtagccaggtctttgttgggtccctatcatgtgccaggccctgagccaggacggggaggtcagactcgaaactcccctgcggccagagctcacagtccagcagggacttggtgacctccacaggctctcttccctggtgactcgaaggttttgggatcacgcagcaaacctgcctagcagaggggtgaggctggagttggcgcctgggttggtggcatgaatgcccaactgggtcaccttctccatcagaaacaatggcagggagaggccctggctctgtgtgggaaagtgctgaagccacaaatcctgccgtgttgtttgctctcaggtctgccatttccggcagcaccccatcgcacctcacagggatcttgggacttaggaagggtctcgaaaacacctctcatttcctctgcattccatgagcctcttagtcttgggcaaaaccctctccctcgctgagctcctggatcctagctcagcccaaagaccccccatacagtaagggagtggatcagatggcaccaagatctttgaagctctggctctggagtcaggcaggcccttcccacttacgcagccaagaacctgtaagaccagctcacgcagacctcagtttccccgtctatcaagtgggcacatgtctgggagcatatcaggaaatgcttgccaggaaggggcctatccctgttccctccatagagaggcagggaaccctcggtgtggggggtgtggggggcagcctgagccgctcactgccgttgcttctctataggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtaactctcagagcccctcctaggcccttcatgtggggacaactggaaaaacacttgtttggaaaaatgtgtttctattataagattatatctaacattttaatagtatactatattaatgtgatagatatgatttcatctttgtgtaatataacagttttctaaaatcgtttttactcactttcctctctgggaagctatgaggggaggtctgggctggtaaaaattctttgggctagtagatgttgtacttacttgcaaggctctttcaaagaagatacatttcttcttcctgctcccaccctagtcaggctaatttcttctcattatattttttggtcattttcaaatgtcctgaacagggtgggttgtcaggggaggggaagacagaaagttgagaaaaggcaaaaatcagttttataagactaaacaaaactaataatactacacagtgttcatgaggatgtggggaaaccaacaatctcgcatgaagctgttggaagaaaataaattggtagaggctttctggatagcagctctaatatatatccaaaaccttagaaatgtacttattttcaggggagctaagctatgaagacacaaaggcataagaatggtacaacggaatttgaggacttagggaaaagggtgggagaggggtgagaggtaaaagactacacattgggtaccgtgtacactaaagaacttattcatgtacccaaaccccacctgttccccaaaaacttattgaaaaaataaattaaaaaatatatatatatgtatatgagatgtacttgttttttggtctagcaatctagaacaatccttctagaatttgttctagggaaataagaatgcacacaaaggtttagttacagtgatgttcatgacagcattccttacaagaataaaaagagtggaagcaatctaaatgtgccatataggtcattgctacaatgaaatacagtatagccattaaaaattgtgaggaaagatggaagggaaaatgctcatgatgtatgataagaatcacgatggatgtacgtgtgcacttttccttctgccttcaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaagcatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgacacgcctgtggtcccgtgctgcttctcaaagctcaggggggcagtttctggctgggctgggatagggagtgggaggagatgctcagaggatgtcctccttacgctgtaacaaataccacaaacttggtggctgcaaacaacacagaaccgtctctctcgcagttctggaggccagaagttcacacaggcagtgttggcagggccacactccctccaaagcctcaaggggaggatctttccttgcctcttcccgctcctggtagccccagtcattccttggcttgcagctgcagcacttcggtctgtgtccctgtggtgacacgtgttctgatgtgtctctctgctccatcttctctttatgaggaccccagtcatattggattagagcccacactcatgaccccaccttaacttactttcatctgcaaaggccttatctccaaatgaggtcacattcactggtgcagggggttaggacatatcttttggggggacacgattcaactcctaacacacagggaggaggtacactgaggttaacatgagcaatttgtttttattattattgtggttaattacacataacataaaatttgccactggtgatagtacattcagaatggtgtgcaacgttaccatgatctaatttcgtattattttcatcacccctaaaggaaacctgtacccattttagcagtcccaccctcccccaacccctggaaaatcaccagcctgctttctgtgtccacggctctgcctactccagacattttatattacattggtgccaaagtaattgcggtttttgtcattacttctaaatggcaaaaaccgcaattactttggcaccgacctaatacaagtggaatcatacagtatgtggccttttgtgaccccggcctctttcactcagcgtgatgttttcaagattcatctgtgtcgtaacgtgtatcagtacttcattctttttatggttgaatgtactccattgcatggataaaccacattttgtttacctactcataagctgatggatatttgagccaaactggtggacatttgggctgtttctacctttggctattgtgaataatgcttcaaaaggagtgatccctgcctgtcacattcttgagagaagtcacaatagtacctgccacggaagaagtgagtgggtgtgagtctgggagatggcgttgccagacttaaaaaataaaactataggatgcccagatcaatttgaatttcagataaacaatagctattttttagtacaagtatgctccatgcaattttgaggaaatgcttatgctagaaatctttttatttgttatttatctgaaatttatacgtatctgagtatcctggcctggagcccacatttcctgacccttgtttcagatctctttcttcctcagcttattcctccttccctgggacaatgaataatcagaacttttctgccattctcattgaggagaaagagcacatcactaacagttgagtttatacccaggattttatattttaaaaacttgcagccgggcgcggtggctcacgcctgtaatcccagcactttgggaggccgaggtgggcggatcacgaggtcaggagatcgagaccatcctggctaacacagtgaaaccccgcctctactaaaaatagaaaaaaaattagctgggtgtggtggcgggtgcctgtagtcccagctacccaggaggctgaggcaggagaatggtgtgaacctgggaggcggagcttgcagtgagctgagatggcgccactgcactccatattaagggatttattatatgaaattggctcatgcaatgatggaagctgacaaatcttaagattggctgctggcagctttgagacccaggaaaacccaacggttcagttcaagtccaaaggcagggaaaaaacctgtcccagcttgaaggcagtcaggcagaaggaattcgctcgtactcagcctgtttgttctattcaggccttcaactgattggatgaagcccagccacattggggagggccatctgctttactcagtctcccatgggattacccaaatgttaatcccatccaaaaacaccttcacagacacacccagaatagtgtttggccaaatatctgggcaccctgtggcccagtcaaggtgatacataaaattaaccatcacactcctcaagctgaggttgaaagagaaggaatagaagtgagccagatggggaagggcacttggggtagagggaacagtgcctgccaaggcccagaggtaaaggtagcactttgcatttgggaacggtaagtgttcccatgtggggctgcaggaaagggtgaggaagcctgcggtatggagctgggaacatgacaagtcacaggtttgcacagatgagcagaggtctgagttggcaagttgggtttgactgccatggggccctggagcagagccatccaggaggcagctgcctgcgctgcgaggaaaggagagaggtctgcactgcactcagagctctggaggcatcagcagtttctgctaggcctggaagacatgggtagagattgaaaaagccagccagaagggccagagggggaaagcaagaagagccatgttagaactgtgacactcacgactctcggcctggtctccaatcccaggtgggccagtgaggatgctggagctgggccagctcattcccagcaggggcagataggaggttgttggggacagaaggaaacttttcctaaactggcagtacccacagttcccaatctcctgttgcacaactgagtgtcaggaaacagtcaggtggacttcccaggctgggccaactccaggggaaagcccaggccagcctgtttgccctgttcacaatgaatcaaaccctagctatggtcacaacccataatggccggcagcccaggattggaaaaatgaggaaaagaagagcgagaaaaagagaggctggcaggcagattccagttcctgactgggacatggccctgggtaggtcattctttctctctaggcctcagtttctctctctgcaaaatggggccgatatgctctgcctttcttgccagccacagaaaggactattgttcaataatagtagagtgaacggtatgaaatagaataatatccaatgcttttggacctgcaaaacccagtttcatatggttcaacccaagaatagcaccattcagaagaataatggctacaatttcttgtgcatggacggcacaccaggtggcatgctcggtgcgatctcatgcgcatgtgcatgtgatcccacattttcatctcatacacaatctcgtgggacacatgttgtaaccctggcttttcagatgaggaaactgaagttcaaagaggtttcttaagttgcccaagatcacaaaacaggatttgaacttgagaaaatctttttgggtctttcctcagcccagtcacagagttccccatgaggacaatttgctcagcctatgtattctcatgtggaagcaggtcacaggttggtcttacacagaccttggctctggccttgatgaagaagggtggaatgtgactttttcaggaaatgaagtgtttcaaacaggtgcatttccctgatgacttccagctcacctgctgtgtgacgtttcccacactgcctcgcctctctgggccacttttttcctcatctatataatggggggaatgtcttattttcttgagcctaggatagacacgttttcatgttttgatatctttaaaagagagatgtagcttgcaatcactgaagtacatatgcaatgcagaaatttttcttccctcctcaccccagcttgtctgggggatggttaaactgacagcgatagttattataatcagaagacccttaggagcaaatttattttatttaacaagcattttatgggtgtggtagctcatgcctgtaaacccagcactttgggaggctgaagtgggaggatcacttgagcccgggagttcgagaccagcctgggcaacatagtgagacctcccatccctaccaaaaaattttaagaactttaaaaaaccaagcattacaactatgtaccaatttaatcttcataacaacccaatgaagtaggtaccactattattctcattttacaggtagagatactgaggcacagagaagttcaccaacttgcgcttcaccaccagcctgtactgcctgccctgaggccttttctctctcttttgttcctgcctaacttcttttgacatcctgccagggccagatggaggatagggccagacgagctagaaggactacttaaagcctcagtctttagaggcattcatgcatacctgaaatgttaggagacagagaaaattgtactgtggtagggtaggtgccagatgagcttggaggaattacttggatagtctaaggtggagagtgagacccccaagcggcagcctgagggacagtgaggacactgaagaccacttactcctgccaaggagaggcactcggaagcgcctctgtactgcattcacagtgcacagctccgctttgaatggtggtagctctccttattcacccttcccctacacaggctgcgcctgggatctctacactcgagcagacggagaccccagaccccattggcctaagtgcctgaacgttataaatcaaaagtattttaaatgaagctgacatgtttacatttaagttttagaaatttaattaattatcccagcactttgggaggctgaggcgggtggatcacaaggtcaggagatcgagaccatcctggctaacccggtgaaaccctgtctctactaaaaaaatacaaaaaaatattagccgggcatggtggcgggcgcctgtattcccagctactcaggaggctgaggcaggagaatggcgtgaacccaggaggtggagcttgcagtgagctgagattgtgccactgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattagccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcagtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaaggacagaggtgcttatctgttatttaataaactgttgtgtgtgggtgggtgtgtgggtgggtgtgatatgtggggctctctaaatccctgggccccaatagtccaggtctaatggtggtgctgtccccaacaatgctcagcttctcctcaaaatacatggtatctgggctgggcacggtggcttacacctgaaatcccagcactttggaaggccgaggcgggtggatcacttgaggtcaggagttcaagatcagcctggccaacatggcgaaaccctgtccgtaccaaaaatacaaaagaaattagccaggtgtggtagtgacacctgtaatcccagctactagggaggctggataggagaattgctggaactcgggaggcggaggctgcagtgaactgagatcgtgccactgcactccagcctgggcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtccccatcatctcacccctggaccactgcatcagctccagctggtttctcaggtttaatctccttccctagccctccccattcttcccattcagacagagcgatctttctgaagaaccaatctggttatgcctttccaacccctttgaaatctttccatttctctcctacacctcctaagtctagcgaacccctcagcctggcttccatgccctgcaggctccatctcctgccaacctcttcaacataaagtctggccactcccacttatcatgtgctccagctgcacagactttccagctccctgatacacccactctctcacctgcgctcttccctcttgataactccaatcattgtttcaagcctcaaattagagcaatgcaaattcaagaaacaaaccaagctggcaaaaacacaaaaaagaaaggaaaaaaaaagggtcatttctgttctgacaaggatggggataaggagactcacttgtacactgccaaactgacattcaaaatccttagtgcttttggatttgtcatgtttgggaggagggtttttaaatcatcggctttcttgaggttgaataaataaaagaaaatgcacacattttaggtttactgttcaattagtttttacaactatacgtgtgtgtgtataatggccaccacgatgacaacctggatcgttgtcatccacttcagtgttctctcatatgcttttgcagtcaaattgccctcttttgcccttggcaaccactgatctgatttctaaaattatagatttgtttgagctgttctagaacagaaccgtacagtatataagctcctttgtatctggcttcttttgttcagcatagtgtttttgagattcatccatggtgttatatgtatcaatagtttaactatttttattgttaagtaatattcctttgtaagaaaatgccacatttttatttaccattttcctgttgatgggcatttggattgtttctttctttttttttggtttttgtttttgcttttgtttttgttttttagacagtcttgctctgtcaccaggctggagtgcagtggcacgatctcggctaactgcaagctccacctcccaggtttgagcgattctcctgcctcagcctcctgagtagctggtactacaggcgcatgccaccacactcagctaatttttgtatttttagtagagacggagtttctccatgttggccaggcttgtctcgatctcttgaccttgtgatccgcccacctcggcctcccaaagtgctgggattacaggcgtgagccgtggtgccccacccttggattatttctaattttggctattttgagcaatgctgttatgaacattaatatgtaagactttgtgcatagcacgtggtttcctttcccttggatactaaggtaattttaaaagggaaattggctgctctctgacacttatcatcagaggaaaaatcacaatatgaaatgctgttagataggctgggagtggtggctcacgcctataatccagcactttgggaggctgaggcaggaggatcacttgaggccagaagttcaagaccagtctgggcaacatagtgagactctgtctctacaattttttgttttttaaatttaattagccaagtgtggtggtgcatgcctgtagtcctagctactccagaggctgaggtgggaggattgcttgagcccaggagtttgaggctgcagttgagctatgattcataccactgcactccaacttgaagagcctgaaaaaaaaaaaaaagtgctgtagacataaaggacatgactaagtaggttagaatatagtaagcgggccaggcgccgtggctcatgcctgtaatcccagtactctgggaggccgaggtgggcagattgcttaagctcaggagttcgagaccaacctgggcaacatgatgagacccccatctctacaaaagtacaaaaagttagccaggtgtggtggcacgcacctgtggtcctagctactcgggaggctgagctgggaggatctcttgagcctgggtggcagaggttgcagtgagccaagatcccaccactacactccagcctgggcgacagagtgagatgccatttcagaacaaaaacaaaaacaaaaaaagaatagagtaagtgaatgaaaagttgtgcatccattacacttttatttatttatttatttatttatttttgagacagggtctcttgctccatcatacaggctggagtgtagtggcaaaatcacagcttactgcagctttgaactcctgggctcaagcaatcttccagcctcagagtccagagtagctaggctttcaggtacatggcaccagacctggctaatttttttgtttgtttgtttgttttccttgagacggagtctcactctgtcacccaggctggagtgcagtggcgccatctcagctcactgcaagctctgcctcccaggttcacgccattctcccatctcagcctcccaagtagctgggactacaggcgcctgccaccacgcccagctaattttgtttttgtatttttagtagagatggggtttcaccatgttagccaggatggtctccatctcttgacctcatgatccgcccgcctcagcctcccaaagtgctgggattacaggcgtgagccaccgcgcctggccgacctggctaatttttaaatatttttgtgtaaagatagggtctcactatgttgcccaggctagtcttgaactccaggactcaggtgactctcccatcttgggtccattaagcttttaactacaaactacactgaaatatgaaagttattcagaatgaaatgaataagaatgcaaaattataatcataccgtaagaatactttctgagtaatcccagcactttgggaggccgagacgggtgagtcacctgaggtcgggagttccagaccagcctggccaacatggagaaaccccatctctactgaaaataacaacaacaaaaaaaattagctgggcgttgtggagggcaccagtaatcccagcgactcaggaggctgaggcaggagaatcgcttgaacccaggaggcacaggttgcagtgagccgagattgagccattgcactccagcctgggggacgggagtgaaactccgtatcaaaaaaaaaaaaaaatgaatactttctgaaagtatttattcatacaaataaagacttgacccgtgaggtaggaacacaaatgggccacggaatcactcattccacagaatataccgagtgcccttgaagtgctgggcactgctccaggattgggggcgtattggtgaaagagaagcaagctgcctgctcagatggcagggaatgggggaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacacagctgttgccacactcagtggaactgaatctatgtttgtcttccccggcatccttcaccccaactctccccgccacaacatacatcccatgccagcctggggaccctcaaaggtggcttcatcattaggtttgtggctgggtcccactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcggacccccactcccggctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccaggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaacggagaaaggccctgacagccacggtctgtgtgaggctcctgagatctcatgtacagaaagtgcttggcgtggagctgggcatgcagcaggggctgggcacacggtggcccaaaggagccctgggccttcactgatgggctgtgtggccactgacacacctaggcctcctcacctgtaagacagacaccattgtgccatcccatgttctcacccagaggctccttttctcttccagtgggaggccaagagcatttcgctcacttgctgatcctcagggacaccaagacctacatgcttgcttttgacgtgaacgatgagaagaactgggggctgtctgtctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccactcatttttaatacccgtgcagtggggaattgatactgtggttttcaatgtcacccacactgcagcacggccacagtcaccatcccgatttttgctacaaatgaaaattactttataatgagctccttaacacttttctttaaacctgtgtttggaagacttgcgttggtgtggccctgtgcccaatacctgtgaaatcacagcaccgatgagctggttccaatttttaaaatatatacatgcagtacttccatgactattcaaagaaaaacaattccttccatttgccatctgagatgaccaccagtggtgtgaactacctcctgcccccatctgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccctggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagttcaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggacgtgtcctcagggtgctcacctgggagacccagaagaaggagacaacacgtaagggtgaggctggtccctggaaatcagttgacatcttgcaaatgtggagccctgaggtggagccaagcccgaggcacagcccactcagtggcacaagccacgaagggccggcctcacccagacctgggggctcatgattgacagcctcttgttacgtgagggaagcagcactcctcccgtggcagaaaagttgggcctgagttgttccatctattccgtatgtgcagctgcgtacaccatacagggtgataagaccatgagcctgaggctctgacaccccagggtccagtcctgtgtcctcaggcaccactcccctttgtacctcctgtcccaacagccaagctccacagggccaagactacagcatcctttgctcagcacccaaaccactgctgtgcccacagcacggaggctggggacaccgagctgatgtcctcagaaggcaagtggacaggacagcctctggggtcccacagtggcctggaactgaaggctcagaacctaaaagaagtttccccatttcaatgttactttcagtaagacaccattttcaaccatactgaggaggatccgctgaaaaatgaaacagaaatgagtcgtgatgggcagggcagggagaagcaagggagacgagaagtggggaacatggaaggaaaagccacgtgaggaagaaaccagaggtcaagagaaaaagaatcatggaggtagaggaagcaaaaaacacacataacaaagaatgtggactttggagtcaaactaatgtgagtccaaacccaggctctctcccaaaccagtttgggcagatggcccagtggaacctcactctcctcatcagtaaaaagggggcagagtgagggtcctgagagctagtacagggactgtgtgaagtagacaatgcccagtgtttagcgtaagaatcagggtccagctggtgctccctaaacagcagctgctgttcactgttgaaaggcgctctggaaggccaggcgcggtggctcatgcttgtaatcccagcactgtgggaggccgaggtgggcggatcacctgaggtagggagttcgagaccagcctgaccaacgtggagaaaccccatctctcctaaaaatacaaaattagccaggcgtggtagcacatacctgtaatcccagcgactcgggaggctgaggcaagagaattgcttgaaaccagcaggggaggttgtggtgagccaagatcgagccattgcactccagcctgggcaacaagagcaaaatggcgaaactccatctccgagaaaaaaaaaaaaaagaatactttctgaaagtatttattcatacaaataaagacttgacccataaggtaggaacgcaaatgggccacggaatcactcattccacagtatacaccgagtgcccttgaagtgctgggcactgctccaggattgggggcatattggtgaaagagaagcaagctgcctgctcagatggcagggaatggggaaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggttggctttaatctccaccagactcttgccccgggactgtgatgggcgattggccacttctcctcgataacattactgtttttcttccgccttctggttgactttagccagaaccagtgcttctataactccagttacctgaatgtccagcgggagaatgggaccgtctccagatacggtgagggccagccctcaggcaggagggttcaccgtgggaacagggcaggccagcataaggtgggggctggatgtagagccctggaggctttgggcacagagaaataaccactaacatttttgagctcttaccacgtgctcagaaaaaatccctaagaagacactgagagaattagatgaggaaacataagaacagagacctcaaatagtttccccaaggtcacacagcttataattagaactagaattggaactccaggctggcttcagatctgcctctctctcacgccctctttaagatcctttgcaaaccaatggtagaagcctgtatgttggagaggtggtaccttcaactatgtcccccatcaccgcagaggtggcacatggcagggatctgatggagctgaactgacatcatttagcatcccgagcctcctctctgggcctcattttcctcctctgtaaaacggggagaaaggccctgacagccacagtctgtgtgaggctcctgagatctcatgtacagaaagtgcttggcgtggagctgggcacgcagcaggggctgggcacacggtggcccaaaggagacccgggccttcactgatgggctttgtggccccggacacacctaggactcctcacctgtaagacaggcaccattgtgccatcccatgttctcacccagaggctctttttctcttccagagggaggccgagaacatgttgctcacctgctgttccttagggacaccaagaccttgatgtttggttcctacctggacgatgagaagaactgggggctgtctttctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgtgcattcccaggtcagatgtcatgtacaccgactggaaaaaggtaaacgcaagggattggacagtgcccaccttgtccatggcccaacttgggcagccccagaggcccagagcaggaaagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccgctcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagtttaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggatgtgttcttagggtgctcacctgggagacccagaagaaggagataacacgtaagggtgaggctggtccctggaaatcagctgacatcctgcaaatgtggagccctgaggtggagccaagcccgaggcacagcccactcagtggcacaagccacaaagggccggcctcaccccaacctgggtgctcgtgattgacagcctcttgttacgtgagggaagcagcaccccttccgtggcagaaaagttgggcctgaattgtttgagcaattccacgtgtgcagctgcgtataccatccagggtgataggaccatgagcccgaggccctgatgtcctggggtctagtcctgtgtccacaggcaccactcccctttgtacctcctgtcccaacagccaagctccacagggccaagactacagcatcctttgctcagcacccaaaccacagctgtgcccacagcacggaggctggggacaccgagctgatgtcctcagaaggcaagtggacaggacagcctctggggtcccacaatgtcctggaactgaaggctcagaacctacaggaagtttgtccatttcagtgttactttcagtgagacaccattttcaaccatactcaggaggatccgctgaaaaatgaaacagaaatgagtcatgatgggcagagcagggagaagcaagggagacgagaagtggggaacatggaagaaaaagccacgtgaggaagaaaccagaggtcaagagaaaaagaatcatggaggtagaggaagcaaaaaacacacataacaaagaatgtggactttgggtcagaccaatgtgagtttaaatccaggttctctcccaaaccagtttgggcagatggcccattggaaccccactctcctcatcagtaaaaggggggcagagtgagggtcctgagggttagcacatggactgtgtgaagcagacaatgcccagtgcttagcaccggaatcagggtctagcaggtgctccctaaatggcaggtgctgtttgctactgaaagtactggaaggctgggcgccatggctcacgcctgtaatcccagcaatttgggaggctgaggtgggtggatcacctgaggctgggagtgcaagatcagcccgaccaacatggagaaaccctgtctctactaaaaatacaaaattagccagacgtggtggtgcatgcctgtaatcccagctactcgggaggctgaggcaagagaatcacttgaacccgggaggcggaggttgcagtgagccgagattccaccactgtaccccagcctgggcaaccagagcaaaactcagtctcaaaaaaaaaaaaaaaaagaaaaagaaaaaagaaaaaaaaaagaaagaaaggagcactggagagtccaggtgcatactcttgtagacagcaacttgctgtgtgcctcatttacatctctggcctcagtcaaaagggacttggctaggcagccccacctcaaggccctccgcagttgaaagatttatggttctgagataggcaaagggggaaaactggagaaacagaagccaccagagggaggcaggcagagcacccaacaggtcccctgggaaagggcttggctgggcatcaaacctaccaccccataaacttgacattgaaggcaaaagttaatgacatacagcagagacacggatggctttgggtattttttttgtcttcttttctttttttaagatcaatattcattcttcatttgccctcgtaacgaaaatagatttttaaatgcctcaaatatacaaacatcattgatgcacacacattccagaaatgcagaggtatgctgctgccacggggtaggggtgcgggaggcggcctggcctcatggccgcagaccgtgccccagcccgggcctggcaggtagctggccactgataaacgccactgggatcctaggagaagctggggaccatgcgtgaggtactgaaggggaccatggtggatggcatcctgggcactttgtagcttgtctgagggaaaggcctctgctgccatagaaaagctggacacatgtcaccctggggccctgacatcctaaaatgccccactgactaccagtcactaggagaaaggtctccggctatgcccttcccagtgatgcttgccccagagtgactggtcacaggtgggggacaggtttgctccagaaaccgtaggcctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggaggcctcgctcacagcacctctgtgaggggactggtgctcctgggaagtcacttctcttggtgaccgagctgacaccccctccacttggaaagcacagggactgagcaggcgggacctgtgctggagggagaccctcctggtgaggaactatgcgggccttctgggcctcagcagctccagcccactcctggcctggcaggccacctgcccacccacccacccatctgcctctgggcccccagtgaagtcagaagaggcaggagccccgcaggctgtgagcctggcgcaggtcggctgacagcgagcttctcatctgcctggtggtagagcggacgctctcggcagcctgcacggcccggctcagggccttgttgagctcctctaggtcgcccaggtcgagctggatggagtgccggtgtctccgggctggtgggggagaggctgtgggcggccacttggcagctggttgggctgaggtaggtcctgcaggcgcatagtacctgaggagagaagtgagtgggctcgttacacatggggagggctggggacaagccgaggagcaccgtgtgtggggtcaacccccttctaaatcccagctgggccagtggctcctactctctgggtctcagtttctttacctctaaaatgggaataatgggcacacatccagggatttcttagaaagatgaaggaagataacaacatgagtgcctgacccagaacaggtgttcaaggacaggaagttcaatctacctgttcatctgatttactgcccatctagtacatgccagccagcgtgccaggctctggggttacagtgggacaagaaaacatggactcctgcaatcttcttggagccggatcttggggaggccaggatcaccctaggcttgatagcaaaaccccctcatggaagaatatctgggggttccatttgccaagcaaggggtgctggagaaaggcaataattaataattaataatagtaataataataataatagggattctgcaggagtgggagggtctggccccatgtcctgggaagtgggtagaagagcatccttcctagcccagtcctataggaatgtgaggtgttgttttaaagtgctgtgggaatgggctgacaagcccattgagatgaagcacggatttccctaagaggtgacaatggcatccatcagggccactaagtttagggttcaaggaaaccagcagtgggcaagagggggtgtggcctcagcactgttaaataaagggtgtgtgtggtggaggagggagataaagaagcatggacctaaatcaggaataagtttaggaggacgcagcagagtcattcattggcatcttgcttggcacactgtaaactctggctttattcctgagcccctgctgtctaacttgcattgttatacagtgtgtagaaacagatgatccaaacagacatttctccaaaggagctattcaaatggacaatacgtacatgaaaagatgcatatccttagccatcaggaaatgcaaagtgaaaccactgcacaccctctaacatcaaaaaggacagatagcaacaagtgttgacaagaatgtggagaaactggaatcctcagcactgctggtgggaatgtaaatggtggagccactgtggaaaacagtctgacagttcctccaacagttaaacccagtgcctagcccagggctggcatcctcatctttggtacccatgtaccagttggtgcctttatctttattttacagatgagcaaagcggagctcagagaagctaagtgattcaggaggcagtagaatgcaccagccttagcagctcaggccctggagccctgccccaaatcccagtcattctgctgggctactcatgggactctggacaagctaagtcactttgcaaggcctctgttttcccacctaaaacgaccacagttagcaacctctcagcttagagctgatggaaaattcaggtaaaaagctggcactgcctggctccggtaagtgctccataaacgtgagctcctaagacccagagtcagacagctggaaggggcagccatgggttcacacctgggcccgactctccccacatatctaatgtgtgctaattggcaagcagcagatgctgataaaataatctgaactgtatgaacgggcttcttgcatccccaaaacagcagcctgcactccctcctctagggaccgtctggtgtaagtaactacagaggctcctcaaattacgatggggttatgcccctataaacccgctgtaaagtcgaaaaatcataaatcgaaccattgtaaaagtagggactgtctgggctgggttttcatacacccccaccttctgttaatttgatgaccaacttggcctgaaagttacccaaaactctccctagggccaacactgaaaaagtccctctgggctggaaagtctcggctgcaggggctatgggacggctgcccagcagggggcagcacaggcccactccgctttccaaactacactggtctcaaccactgggcccgttcagtcctgctgaccagcagctggagaaatttcagggtgtcaccagcgcaaattctagcagcattagaagcaccatcattattggcaacttctatgtactatgggctttccatgcattaattcattcaatcctcagcacaacccatttcgcagagaaggaaactgaggcataggtataacccgcccatcctgagttggaaacagcaacctggtgagttctgcccacaggcctgagcctggaagaatgtgaaatggggcctcaggagaagtaaagactccatggctaccgtggggtcaccaaattctgggcaaaacctttcccgatcaatgagttggaacactggcaggcgctttcccccgtgtctgctggaggtctgagcatgcagcattggttctcatctctgctggagtggaagattccttagcgacttgcttagactcagctgagagggcagcaagaaagcaaatttacataccgggcgcggtggctacaccttgtaatgccagtgctttgggaggccaatgcgggcagatcacctgaggccaggaggtcaagaccagcctggccaacatggcgaaacccatctctaccaaaaataccaaaaaaattagccgggtgtggtggcacactattgtattcccagctacttgagaggaggaggcatgagaatagcttgaatcttggagatgggggttgcagtgagccaagatggcgccactgcactccagcctgggcgacaaagccagaccctgtctcagaaaacacatatacataaaaaatttttaaaagcacatttataggcctggtccccgaatagaggaccagggctggatggcgccttgggtccctgctccaccaagcaccagccctcacagtgacgcaggccctcactgcctacacacccaggcttctggcaacacagccactgaagacatccagtcccaatcgactcatttcacagcaggggaagcaggcagagaagtagctgctgacagctgagacaagaagacaggtttcctacttctggggactgggcttttgtccctgcacaatcctatcatgttgaacccacttttactccttcttcttcctactagtgacaacactgagcaatagcaacattctctgtgatggcgaagctactgtttgctcagcaatgagcacgtgaccaaatggcaccacaaactccacacacttctcatttggttcctgccacgtgccacacttaatcctcacgcacaggattaagtacgtggttgagactcttcctccatttaacagatggggaagtggaggctctgagaggaagttagtttgccaaggccacagtgctactagggggcagatgggactccacggtagctctggccaactccaaacccaagccacttctgtctcggctgccctgcctctcctggcttgactgatgttacgtccagaatctgtgcaaaaagtcctacaatattcccgaccaggactccccagagatgtccaggtcatcaaaaacaaggaaggtctgaggatctgtcacagccgagggggcgtaaggaggcatggcaatcgcataccacatgggatcgtggatgggatcctggaacagagacaggactttggaggaaaacggcctgaaggaactacgaacttcagttaccaataatgtatggatattgcttcactaacgtggccaatgtgccacattattgtaagatattaataataggggaaactgtttgtgcaggagtgaggaggattgtgggaatctctctggactatctgctcaatttccctataaatctaaaactgtcctaaaaaataaagtctattaaaaaaaacccagtgctcatcacttacttgcggagaaaacccataaggaaaatggaagatggttaggattctcagtctccacaaagttataagctcccagagggcagggccctcttgctagtccccttcactgctgggtcccagggccgagcactctccttggtacatgggtttgttgagtgcctatatgagtgttggctttgttgagtgactatatgagtgttgggctcctactgcatgttatccacgcagggataaaacacaggaggagtatactgcatctcagctgccccacccaggtctgaatgctaacatattcagtgatctatagaaagaggctgggaaggtcagaatgaaggctcttacacagcggcaggtggataaggcatgatgggaaccgaggagatgtaggcaaaggctggaggggctggtgctgggggcgctgttgccagataccacagtccggggggtgggcgtggcgacgaccccgcctgcttgctcctctgcttggggctgggagttgaagatgcttttctcctcgtggtggccttctctgcccctatcagggagggaacagcacagagagacagagtctgaccacttggcagatccagccaaagatggagggtccacccagcccttcccctatgagagctggacaggccctaccctgtgagactccatgtcggggaggtctctctttggggaacaaatcctctgccccagttgctctgtcccagactggaacaacagctgctccagttaaactcacccaggtctaataaccctggtcaaggagagctgagggtctggctaagagaagaaacagtatttgtccctaccagaggtggctgagcctggaccatctgcctctgggggagacccaacttgaccacacaggggacactgaagggtatcagcgggaggcggtcccagtgggtcccctgtgacagcaccacctagaagaggaggaagagatgtcaggggaggattacatctaaatcatcagatcaggagcccccatgcaggccttctgcagcactgagctctcctcgggacccactgcggaggggacaagctgcctccatctgggtgatgacattgacaacaaccatgacagtgagagcaagcatttagtgagccaggccctctgctaagggccttcctgcattattttatcaaatccaacaagccactgggctagccactgtcctcactcccccactttacagatggggaaattaagggtccaagacgtcaagtaatttgccaagggtctcagagctgggaagcagtggtccttggatcctaagcccgggctctcccaaatgcagcccaaccccccgccccaaccacagtgagacagagccattctccatgtgggagtggcccagaacagtcccctggggaaccaggggggtcagtagaggcaaaagggaacaggaggagagtgggtgccattgttctcttcccacatacatccccaatgccacacctgggtgagttccagggctggtctgtttctctttcaggccttggctcaaccaccactccctctgggaagccctcccacccaccccggcagagtcaggcaccccccagccccactcgtgctcccctaccccagctttggccactctgctttgttgtgtgttccttggggacggggcccagggccccataggggtaagtgatgaatgaatgaatgaatgaatgaatgcatgcaggcatgaacggagaggcctgtcaggactctaacactagcacaggaagagcatagtggtgaaaaggtgggactctggagtcacaaagacctgggttcaaatcctgcttctaccacttgtaagctgtgtgcccttgggcaagttacttaatctctctgagccttggtgtccttgtctataaaatggacgtaatagtactgcagtacttagttcatagaactgtgaggattaatttatgcaaaacccttaacatgacaccctctacagagagggacttaataaatggcagctcattatcatcagtcattatcatcactattgcttgaaaagtcctagagaccatctcttccaatcctttcattatagatgtggtgactgaggtacagagaagtcaaggaactggcctaaggtcacacagcaagtcagtggcagaactgggactagaacccattgcctggattatcgggccactgctctctctgccactcctgtggacttgggggaaagtatgaggggtgaagggaggatggaggggagaataagacataatcactgatgccaggtcccctgctgcctggaggccacctatcaggacccttcaggaacttcttaaatcaaggagggtggcttcaggcagcagcacctgaagcaacagatgtgacggcaggacacccagaaaaatcctcttccctggtctgtccctataacccactgctaagttcagggcaggccagatcttgtcaagtacacactcccctgagggcaagaagctgcagccacagctgcctgggccagttttccaggtgccattccttacccgcatcctgggtcctaatgggccggcagtggggacaggagactgtgccattgccttttgggaccgccttaggggacagaacatggtattcgtggcctggggaaagaaaccagaactgtcagtatcagccctgtggatggatgcaaaatagaggaagattctggaataatgatctcctcttcctccaaatggttttaatagtctctgtctctctctcacgtgtgcacacggtgagtgtgcatacacacatcatgtgtaaaatatgtacatatttaagtatgacacacatacacacatatacgtcaccgaacatctttgtgtctgtttattgtaagctttctccagactcctattctgtttcatctcagatcctagaaccagctgacatccagtagcaaccaacacacccaggctaagtcaggatttgaaagcaggccaggaagaaatgataagcaaagcaacaataagaaatgaacaagtgatgctattccccacaccccgacttgctggtttggttctgaatggctcgggcacagggtcagtggtgttttctccccatgctctgagcggctgtaacatggggataaacatagcgcccatttcacaggcttgttgggagaactgaacggggccgtatccgtgtcgtgctccgcccagtgcctggcagatggaaagcagttgatgttatgagaaagctgggcggactgtggcctcctcacccagccccaccacctcctgccttacccacccctgagtttcaaataaggccttctgggtgacacctgaagccactgtggagcggtctcatcatctcatttccctcctgtgctgttctggctttgtgtatgtggagctgaacgtaattgctcttattttcccgacgcgacagatgaggaatctgagggtcagagaggctcagagccattttctgtgagactgacttcagagtctttggttttgacttctatactctcttcctctcattgtgttggaagcatttctccaggttaagctcactattaagggttaagatcacctttaaaggctacagaaaacctcatccaatgatatcatctctttccttttgctagtaagtccacagagagattgtccggtgagcttggaggtgttcctgctactgtcgtttctaactccttggcctctgtccactccctcgttatggtccatggagcagaatgtgcctctggcctcttgccttgtccccagaatctgaggtcagcagccctccctcttctgcaaggtgtctgtgagagatgatgcctttactataattacctattggttatcatcttctctgctacagtcagattcatgaaggtgagaaccatatccatatatatatatatatatatatatttatgtatttttgagacggagtctcactgtcacccaggctggagtgcaatggcatgatcttggctcactgcaacctctgcctcctgggttcaagagattcttgtgcctcagcctcccaaatagctgggattacaggcacccgccaccacacccagctaattttttttgcatgtttagtagaaacggggttttgtcacattggccaggctggtcttgaactactgatctcaggtgattctcccacctcggcctcccaaagtgctgggattagaggtgtgagccaccacacccaacccatatttttgtgttaatgttataagcacttgaaatgctaccatgtgtcatctcaagtctttactctgtgccaggtcctgtttcctgagacacaggggccctctggaaatgagaacctgaaggaagccaggtgcaaatgggacatccaattcagtgtccaccctgtatgctccgagccggaaaagcacaggtgatcagaacttctttaggattgaccagctgaacagacttcccagaaccaagcatgggccctggcaaaggggaagcatcagaaagtgtttgctgaatgaatgaatgaatgaatgaatgaacaagtgcaccgagattcatggaggcaatgctccctgctggttttcatatcacagaactgatagaaaatgatatttgaatggcccactgggtatatggaaagggcttctcataacagaggagcccccgctgacaccaggagctgcacccatcccggccctccctcctgacctacctgtgtattggccccggaaggtgaccctgtctggccatccagcactgcccacccctctctttccatcccgagctgcctgtggactgtccttggtggtcttgctcttctcagagaacagtggtagggagggcagctcagattctgaacctggggtagaaaaagtggggcatcagagggggcaaggggtgggggtcacatttctcaaggagtgggtatgccatgagtttaggctctggggtggatgcctgggttttaatccccagtctcccccttaggagtaacagctggcatttccagaaccctgcccccgtgccaagcgctagtctagacgctctgtgtgtgccgtgttgggcaccttcacagcaatcccacgatgtggacactgttataactacatggtgagctgtccctttaactgctcagagcaggtaaacaactcggccaaggacaagtggaggggagctcgctgatcccggctactgactccagagccctgatcctttagcacatcccctgcgctcattgggcttcagcgcccttatctgtgaaatgtggataatatgaccatcttgcagtggaggttaagcaagacagcagctacaaagcccttacagacaccctacacgcagtaggtgtgcaggactttagaagtgctctgtgcttcacagcactataatatcctaaaacagatgcacaaaaacccttctccaagtttccttgaatactgttgctgtggtccctgaccactgagccaacatgctcagactgtggcctctggaaatcagcctttgcaggtggtcacttactcagggacagtcggagcacctcccgaggcactgaggaagacctggctcgctgccttcctggagggacaatctgctcttcacctctaggctcaccaggcaatctctctgtggatttactagcaaaaggaaagagagatgatgtcattggatgaggttttgtgtggcctttaaaggttatttgtgagaagttcaacctggagaaatgcttctaacacgatggaaggaagagagtatagaagtcaaagccagactctgaagtcagtttcacagaaaatggctctgcgcctctctgatcctcagtttcctcatctgtcaagtggggataataacagcaattacctcagagggttataaaaagattaatgagaaaatgttcataaaacccttcatcaagtgccctcccatagactcaaaagaagccagctgattttatgtcattgtcataaatgaacaaacaccgaattaatgggtgagagtgaaggcatgctggcaatgttctaactctttggttgggtggtgggtctagggatattcattgtattattctttattattattattattattttgagacagagcctctctctgttgcccaggctggagtgcagtggcacaatctcagctcactgcaacctccgcctcctgggttcaagcaattctcctgcctcagcctcctgagtagctgggattacaggcgcacaccaccacgcccagctaatttttgtgtttttagtagagacagggtttcaccatgttggtcaggctggtttcgaactcctgaactcgtcatcttcccgcctcggcctcccaaagtgctggattacaggcatgagccactgcgcccggcctattctttattattaacatagaggtttatatattcttttgtgcatcaaatactgcacagtgaacaagctcaacagtgaatgaatgaatgagtgagagagggatgtggcagtgcctgagtccatatgtctggggagagccagaggccagccaagactatcttctgtagctgccaccaggacagaggtgggagttttgaggtcacccacctgccataatgggagccccaggtggctggggagtctgctggccggccgcgggtccgggcggggcggtcaaaggcagatgctgggcgtgtcgggctgccctggagtggctggtgcaggctgtcttccagccgcagacgaagccgggacacctcttcttgcagctcacagatggcctggctggggttggagtggagacagaaacaaagaacagaggcatgaggaacagagctgcagccacccgagtatgccaggatgcggcagcctttgtcccttcacagcaggcacagggtctatctctgctgtcaaacgattctagaactttcctgtgcgacacttttcttgctacacaacttgacacctttctgagttcatgtccctgtgcagtgaacaaaacagaacttttctttgaagttttctcttcctaacacatggggtctgagtggctgttcaggaacaccagtgacaaattctcgagatggagacaaggatgcagcatagagagggccctagctacagttctgccataaaataccaaccttcactctctgtccaggcccagctcctctccctaccactgtgcaagcccatctctccagacctggcagaagatgcttgtccaccatctccccacacagacagtgagccgccagcagacaagaaagaagcgggcttcctgtcttataacccctgaggccctgcaccttgtggatgctcaggaaacagtactgcagtggatctgggctctgagacggagcagaataaagcgctgtgagtggagagcggacagggagacacctcgatgcttcctagcaccacctgaaccgggagggctgactaagagcaggctggaagctgtctgcaagactatagtaaatcctggtgaaacccccaacatggtccaacctccagccaccagcactgagggagtaaatcctgtctgtgtttctctccaatcagtccctgcatcttcagggtcttgttttgtgggcattgctgacaccgcagcagacaatcctacccagatacccctccccacaagaccccctcaaccacggagcagcgttagagccaggctcagcaaagccaccctccaggcggatgcaggctccacatctacttggtctggcttctggggtgggaattcccactggggccgttcttgcctggtggcccctggactcctgggtgagtatcccctggtgccgcctccagcagacatgagcgctcagatgactgtgtcagaaggagtggaggcctcttcctggctgtgccccagcgctgagtgtgtgtgtctgagggcagtgggttcccttggtaatccccagggagacgcttgctggtgtttctgaggcaaagccacgagggcaagtgtgggcggtggctactggagagtgacatctccccacccccagttaactcctgaaatggagagctccgcctcctagtcagaaggcactaaaaaaaaagacttaccaggccgggggcgtgagtcagccacttgggtatctcagtctctctgatgtaactctttagtttcttactgagtgccagcaggcacttaacattcatctttctctgcaaacttacttccctgtctctgcacatggcagcagcatctacctgactagccagacagaactctgagtcactctagatcccctccttccctgaacatccctgaagttaattagttaccaagtctcatgggcccaacttccaaaatacctcttcccaaatgaatcccttcttcccctctgtaggggccctccccgagaacccagtccccatcatctctctcctggatgtggcagccttctcagcagtctcttggtctccgttctcaccctgccggtggccagagaactctaaaacataaacctgcctacgctacgtccctgcttaaaatccccttccctgtcctctcagcctttgtgcactcatggaatatgcagtgaatgtctccccttacccatggccttcaggccctgtaggatctcccataggtctctcctctctacccctctcttcctttactgctcaacactccaccccctcacactagaggatctggctgaccgtttagctcctccaaggtgatgggcactctctcacctttaggactttgcacatgccattccctccactgaagatactcttctatctctcttccttctgatgtctgctgagataccacttcctccaggaagccctccctgaagcctctaaccggaccagatgctccttcgctgtgctcccacagtcctttagtcctctgccatcatggtatttatcacaatggagggcactactgcctgtttctttgtctgttcatcctacaagatggtaagctttaagaggcctaggatagagtcttgtccactattgtattcccaaggcctggcataccctagacaaacaagcctctaattcctccactgatgtcaggggaggctgcaggggtagacttactaaactcagacaaggaagccaaacaccagcagctggacacaactttgcacgtaggcaacatgacagcctcatgcctgttcgagccaaagaaaccttggctgggccaccaccgagcagtctccccagcgcatcccgggacagacacccactccagcaagggtgtgtaagtgatcactggccaaaagcaactaagaggaggtgtgagagaactgaccaagcgattttaccatttctgttcaaccaaggaagtggaactttcttagtagaaaaaatgcacacgaaccaaaaaaagaaaagaaaaactcagaaggcagtagcttcttggtccatacaatcaatggtcaaattgcagaaaagatagccctagaaaggacaggcttttctcggaaaagagatgatggagagagagggcataagtgtcagcaccagaaaggtgaatctttaggtcatattccactggctggagaagtgtgtcctcgatgtctagatcaatgaggtcccacagaaacgctgggaactgggaggcaggacacctgggtccgtctgctcctaccaccaccatctgtgtgagctgggcaggtctccacctccacctgctaacacgtcgcatcacgctcccgtctgtatgatgagcttgaatccccaggatccaagtgtctaacttactctcgccctgccctggtgagcaggaagctggggatggtctctgttggtccacagggtagaggcgcagcggcaggggcgggggctgggggtgggctgattgtcttgttgggaaggggctgttcagaaatccgtttgtgcccctcaaactctgagccaggaaccgctagggaggcagagagagaacccaaagtgagtttaagcagagagaacttccaagctcacacttgtgcaggtggaatgatgggggaagtgaagagacggtgcctagttcaaggtcacaaaggaagttcctgatgaggccaatgacccacactgacctccaaaccagaagatctagattttgctgggagtgtggggtgctgagctgggcctgccccgctgtttctaaccagaacccctcctcccacccaccatgacaccatccgagtcttcaggaacttcccctgcaaagaattaatcacttcttcacttgggttcctcaagacttgatcaccttctcaccatgtttttgtggggctggcttcagagcctcctctgaaattatagtcacctctttccacgtatgcatgtttctggggagagcattaataacttttaacgaatctcccaaagggatgggtgaccaaaggttaaaaaccactaatccgtcccctgcattaaaagcaatgaactggccagacatggtggctcacgcctgtaatcccagcactctgggaggctgagacgggaggattgcttgcgcccagaagtttgagtctagcctaggtaatatagaaagaccccatctttgcaaaaaaaaaaaaaaattatatatataaaaaaattagctggatgtggaagtatgcccctttggtcccagctacttgggaggctgaagcaggaggatcgcttgggccagggaggacaaggctgcagtgagccataatggcgacactgcactgcagcctgggtgacagagcaagaccctgtctcaaaaacaataaagaaataaataaaaaataaaagcaatgaaacccttggaatactactcagcaatatataaaggagctaactattaatacacagaataatctagataaatctccagagaattatgctgagtgaaaagccaatcccaaaaggttacatagtatatgattctatttatagaacattcttgaaatgataaaattatagaaatggagaacagattagtgcttaccaggggttaaggacaggctgggggcaggagggaagtgggtgtgcctatgaaagggtagcatgaggctccttgtggtgatggaacgttctgtatcttgactgcatcaatgtcaacatctggctgtgacattgtactacagttttgcaagatagtctcactggggaaaactgagtaaaggcacatgggatctctgtgtattatttcttataactgcatgtgaatctacaattatctccaaataaaaagtttaattaaaggccgggcgtggcggctcacacctataatcccagcactttgggaggctgaggcgggcggatcacttgaggtcaggagtttgagactagcctggccaacatggtgaaacccatttctactaaaaatacaaaaattagctggacgcagtggtgcatacctgtagtcccagctactcgcgaggctgaggctggagaatcacttgaacctgagtggtggaggttgcagtgagctgagatcgtaccactacataccagcctgggggacagagtgagactccatctcaaaaaaaaaaagtttaattaaaaacgtttttaaaataatgaaccagctgggcgtggtggctcatgccggtaatcccagcactttgggaggccgaggcgggcgggtcacaaggtcaggagttcgagaccagcctgaccaacatggtgaaaccccatatccactaaaaatacaaaaattagccaggcgtggtggcgcgtgcctataatcccagcttctcaggaggctgaggcaggagaatctcttgaacccgggaggtggatgttgcagtgagcagagagtgcaccattgcactccagcctggacaacagagcgagactccatctcaaaaaaaaaaaaagatgaaccttttaggcaaagctaatctgaggtgtcagaagtcagaacagtggttatgtttgggaagcaggtagtgactaaatgggacttcagtgaggttctggggttcagatcatactgagtttcttggtgtctgttcaccttgtaaaaactcatcaatttaagttctttttggtggtttttaatttcaataaataattcatgtgtatttctaaaggtcaaaaactgaatcacatatagatttcatagacatggaaagtgtttatagtacaatttagtgaaaaaaggaggtcgccaaatattcacatataaaatgatcttattttttgttttttttttttatgttttttgagatggagttttgctctttcgcccaggctgaagtgaagtggcgcaatctcagctcactgcaacctccgcccccgggtttaagccattctcctgcctcagcctcctgagtagctgggattttaggtgccagccaccacgtctggctaatttttgtatttttagtggagatggggttttgccatgttggccaggctggtcttgagcttctgacctcaggtgatccacccgcctcagcctcccaaagtgttaggattacaggcgtgagccaccgtgcccagcctcatttctgttttaagtatagtcacgcatcacttaatattgggtataagctcccagaaacacattgttattctgtttcaccatgtcacaaacatcatagattacccacacctattacatatgtgaggtagatggaatagcccattattgtaggctacaaacctctacaacattgcctgctgaatactgtaggtatctgtaacacaatggtaagtatttgtgtatctaaacatagaaaacagaccataaaaatatggtataaaagattttaaaaatggtacacctgtaaagggtccttaccatgaatggagctcgcaggactggaagttgctctgggtgagtcagtgagtgagtggtgagtgaatgtgaaggcctaggacattactgtacactgctgtagactttataaacaccatacacttaggctaaatttacaacatttatacaaaagttttttcttcaataattaatcaagtttaacttacagtaacatttttactttataagctttttaaatggtttttaaccttttgactcttttgtaataacatttaacttaaaaatacattgtaaagtaaaaaatattttctttcttgatatccttataagcttttttctatttttaacttttttttaaaaaactttaaaaacttttctgttagaaactaagacaaacacacacacatcacagacacacacacacattagcctaggcctgtatagggtcagggtcatcaatatccctgtcttctacctccacatcttgttcttctggggcaataatagcactgtcatctgtgataacaacaccttcttctggaatacctctcgaaggactacctgaggctatttaatagttaacatttttaggctgggcgcggtggctcacgcctgtaatcccagcactttgggaggctgaggagggcggatcacgaggtcaggagatcgagaccatcttggctaacacggtgaaaccccgtctctactaaaaatacaaaaaattagccaggcatggtggtgggcgcctgtagtcccagctacttgggaggctgaggcaggagaatggcgtgaacctgggaggcagagcttgcagtgagccgagattgtgccactgcagtctggcctgggtgaaagagcgagactctgtctcaaaaaaaaaaaaaaaaaatagttaacatttttaaaataagtagaagaaatacactctaaaataatgataaaaagtatagtaaatacataaaccagtaacagagtcattagttatcaagtattaggtactgtacataatcgtaggtgctatacggtactttttttttttttttttgagacagagtcttgctctgtcacccaggctggtgtgcagtggtgcgatcttggctcactgaaacctctgcctccgcctcctgggttcaagcaattctcatgcctcagcctcctgagtagctgggattacagtcgtaagccaccacacctggctaatttttgtatttttaatagagatggggttttgtcatgttggccacaggtgatcctggccttaagtgatcctcccaccttggcctcccaaagtgctgagattacaggcatgagccaccatgcccggcctgtactgtacttttttttttttttttgatacagagtcttgctctgtcacccaggctggagtgcaatggcacgattgcagctcactgcaacttccacctcccgggttcaagcaattctcctgcctcagcctcccaagtagctaggattacaggcacctgccaccatgcctggctaattttttgtatttttagtagagacggggtttcaccacgttggccaggctcgtctcgaactcctgacctcaggtgatccacccgcctcggcctcccaaagtgctgggattacaggcacgagccgctgcacccggctgggactgtactttcatgtgaccggcagcgcagtaggtttgtttccaccagcatcaccacaaacatgtgagtgaagtgttgctctgcaatgactgcaacatcgcaaccaaaggaattttcagctccatgaaaatcttatgggaccaccgccgtgcacgctgtctgtcgttgaacaaaacgttgctatgcagtgcatgacagtatgtgtaaacaaacacacatttatatcggcacagagaacagctcacaggttctacaccaaaacgtcagcactgatggtttccagagtatttttttttcttttgttcccttttgtccacgttatctgtaatttcaaatttcagtacaatgaacctggctaatatgtcatatcctaaagggttctgcaagtttttctatttgatttttcaacccatgcagttctgtccaagtcagactcctgcactcacccatctcggctgccagtgtccgctccaggctgaagttgggtgccctctgccggagaggcccacttgggctggagaggtacctctgtgcttggctccggggtgtgctgggctctgtggctcttctgggaatcagagaacccctggccttggggtaggaagctccatccctgggcacagatgcagcaaagggctgggctaatgttcctgctgtgctgggggaccgtggaggaagggacacacaggggtcacacagagtgagacactcaggcggcagcatctgagcccctccacatgctaacccaataagctcccaccctttgtaactttgcatctcgggtggtacaatatttccaaggacacacacacattagatgcccaattctttgtaaactgttcactggccaacccaatatgcaaaataataaagctcagtttatgtgtagaatacataaaagagaaataggatttctaatccttcctttgcatgcacccttgggttgccatgtgggcctcctgaagggcctgcacccagctttggaggctccatccctccactcttcacccctgtcccctccgccttctcccttccctttgggttccatgtagccaccctgagtgccctttgcccttgtcttctgttcacctcacagtgccctccctgtagtttttattcattcatccattcatttgctcaacaaaaatgaatttcccagtctgtcgctaattagctatgtgaggctggactagttactcccctctctgaagctctgtttcctctgtccataacacaggaacaagaaatcacggttaggggatgaaatgagggcctacgaatggacagaccatcctctcttattctgggccatcacaggcactgtgattcccaggctgtcccaggaatgtggcactgacgggacaatggcgggatcccgggatacctgatgtgggagagccggtgctctggagtctgggtgaggggtgaaactctgcttgtttctgagcccacaaagccactgtctgtctctggggacgccatccaggtctcctgaaagaggcagtatccctttatgtctgaggaatgtgtccaaggcacactgggaagcccttcccaaatcgtggcctggcctcacctcccagaggctcacaccccagggttgctggcccagctcccaacagccaggcccaggagtgagggctctcaggctctcaggcctcagcacaagaatctggctaccagcagggactctgcaccccaggaggaccctcagcaagtgctgcctccctgaggggtggcagccagagcccttgggagagacaaggccatggacaaggactagcaaggggagagggagaaagccttatttccagtgtctcctggcttaggcctggaatactatggtcttatctgacagtggaaatgctcaggcccaaggcattggaaaaacgagaccatcaaatatgtacaggtcctacccgctgggtttaacacacggcacagagaacacaaacagagcaacacaggtgcctgccctcgctgagttcatgtctagtgcagagaatcctgaccatgggctcgttaggactacagaagtgtgtgtgtgtgtgtgtgtgtttgtgcataagtgcacatgcatgcatatatatgcattattctatgacagtcacatttccatagtggcctgtgactttgcagcagtgatgtctactctaaagagcatagaactagtctctccagctgtgatgggcaggctcagagaagtataagcaatgggttgcaagctctcagaggaggaacaagagctccggaagagggacaggtttggggggtgacactgagcataagtcctgcatgtcaggtgggattgtggctggcagggacaggagcagcaagtattccaagaaggaatagcacaaggaaagacccagaagcagaaagttgagaagacccaggaatgaccctgaggttctgggcccattcccccatgtggagacttacctccaggtggggcccaccgcctcggtgcaaaggcttctgtggaaggcgctcagagatgccgcttccctccaggctggtcatactactttggtgggatgctgcggacttggtgcctggagggtggggtggcacgccagggcctggaggggctgcctcagccttgcccaggcctgacatgtgcccgtctctagccagggatgcctggaaacctggtggcttcatagataccatcttctccgtggcctccctggcatgggaagagaagaccatccttgagttctgccaggcagccctgacgcaggggttggcctgtcctgggagccaagcagcccagggcacaagctctggagtcagacatccctggctgcccagcctggttctgccaccttctagctgtgtgacctagggcaaggcacttcccctctctcaacctcacttttctcaactataaaatatggatgccaacaaaacccacccaacaccaaagaggaaatgttaaagcagcatttcccagacttaaggagtttgcataccaccttccctatttcagtcatttccataaacttccatctactccaaagattttagatcactattcaaaacagaagatcagtgtgtcatgtgacaaacagaaactaactttgaggataaatataagaaacctgaatattatcatatactagatagatccacttgcctgctaaatgctctaggccttgtgtgctctcatactgtctctctctctctttttccacagaagttcaagagaggcattaaagacaccacagctctcagtaaactatcacaaggacaaaaaaccaaacaccgcatgttcttactcataggtggcaattgaacaatgaaaacaaatggacacaggaaggggaacatcacacaccgggggctgttgtggggtggggggagggatagcattaggagatatacctaatgttaaatgacgagttaatgggtgcagcacaccaacatggcacatgtatacatatgtaacaaacctgcacgttgtgcacgtgtaccctaaaacttaaagtacaaaaaaagaaaaataaaaaagacaccacagcactaactgagactttctccttggcatcattagaaggtcagagacagaaaaagagaatgatattcttttttctttttttttttttgagacagggtctcacactatcacccaggctggagtgcagtggcccgatctcagctcactgcaacctccgcctcctgggctcaagagattcacctgcttcagcctcccaaatagctagggctataggcgtgtaccaccatgcctggctaatttttgtatttcttgttgagatggggctttgccgttttgctcaggctagtcttgaactcctggactcaagtgatccacctgccttggcctccctcaatgctgggattacaggcatgagccactgtgcccagctgagaataatgttctttaatactgcatgtgtcctactgaaaatcatgtcccacactacccaaaatcatttcaagggctatcagtggtatacattccacacttgaagaggcaggacaggtaagccatgtctaaactgtgaagcgctgtcttattcactctgacagtgatcatccctgtggttttagggtggaaacaaacattctgcaggaaaggctcagtgacttactccaggggagccccatgacttttctcagcctgcaccgggcactgccttgggaggaccctggtggcctctgctttccctggagttgcagccaccccatcaacttccagggagtcacctcccccctcttcctcctcctcctcctctccttcttcctcctcctccattctcatggcttctgggagagacttcacactgaggtacctgcagaagaacacacagaggggcatgacctctgcccagtgggggacagccaagatccagctgctggccagacaccctggtcaggtccaggtggcactcaccgctccatgaggccatggtaaacttgctccatctgcagctccttgtgcctgagtcgggccagggggtcctgtggcctgtcctccacctcactgttgccagagctcacctccacatttacgtgcaatgggcaggggccagtgctggcggcggcagtggtggtagcaggctggggtcagaaagatggacagacagagattcagcagatagttaaacaccacttttaagcacttacctcctgccaggctcgagctgtgggctgcggggtaagaagcacattagactcactaagcccaccacccttttatgtatgtgtaaactatggagactgggctgtgtggtcttcgatactggctgccatgaattgagcacctgctgtgtgccaggcaccatacagataccatgtcacaacaatcccaccagtacctacgattattacaaaccattttatagacaggtaactcacgctcaaatgatttgcccaaagtcaacagaaacaaggagcagagttgagatttaaacctagatttcctgccagagttaactctcctgacccccatccattccagcatggccaccccagccccctgcaataccttcaactgcaggagcatgagggtcccttaagatattgtactcaggttttctccccattcaagtgtgtagtggcacctggtagagttttcctaccctctaggccagagcacagcacaagattttccccaaaccatagggccagcatgacctcagctgtcagggatgtcctaccagtgtcccaccctacccagcatgccaggctctctttcctgctcccatcctcaacagacaagtctttgcagcacaggcaacaggagttgggaggcatagagaccccactactgtcatctgtgtgaacgcactacactcaatttgctcgcctgcaaaacggagatagtgattgtctctcaaggggttgtggtgtgggccagacagccttctacaaagccccttttgtgtagggctcttgtctaggtttcaccccattatccatgcagtactacaagctagaaacctggagccatccgtgtctcccttcctccctctcacggccactccaagtccactcaaacataccttcccaacctctcttaagtccacacatgcttctccatttgccctgccacctccccagcctcagactggcctacccacaagtcatcttatgtcatcccctgccagaaaatccagcagagtttaaggccatgctctctacgtgacccacaagcccctacatcatggggcccctgcctgcctctccagccacatctcagactatttttcctttctcttcccatactctagccacagggcctttgcacaagctgttttccctgctggatgggttttctctttctgtctctagtaattcctacttagtctcaggtctcatttaaacatgacttcttcagggaaagcttctctgacctcctcctcaaactcagtcatgttactcctgctactctcacagaaccccataattctccttcagtgcactgaccaaaattataactaaatcactgtaaccagttcaactctacagaaaactctgtgaaggtagacgccaccttccctgccacctcccatcccactgaatccctaccatgtgtcatggtacatggcacacacttcataaatatgtaatatttacatatttggcacacactggcatatggcacacacttcataaatatgtaatacgtattgaagaaatgaattaacgaagaaatgaatgcacgagggaacagcccaatatggttgagccaagaggtacctcagggcaggaggtcttgatggctggcatgggggcttgtccagaaggagcaggcaggtgcgttggctgatggaggcagggcagggctggggtgctgtccagagctgagtctgacccgggcggctcaggctcttgctgggtctggtctatgtgttccttcagctcttccaggcagcttcccagacggtatatctctgcctccagctccctggaatgcagaaacattaccaccaggagcccaagatggcagctacatcaggcaggtccaggaacagagtatcagagcagagactccaggggatgcccccttagggtccatttaatatcagcctttagatgatggtgagaactcaaaataagcaagatgaaagaaggttccattgggaatcaggaggtctcagcccaagtcccctctgccatccacaggctgtgggacattagagaaatcccacccccatctagcctcagtttccccatcatccaataagggtttcaaggcatcttctcagcacgtgggtccaaagggactcaaatcacagcttttgatcgtgccaccatttggatatgtatactaattaggataagatttctctctattccccgtgtacaaattataaggacaaagtgcctccctcctggagactgagggaccccaggggcccatcccatctgtccttccaggccttccaccccagcaggtacctgcgaggatcaaatcttccaggcgtccccttggagccggcaagcggctgggcagggtgttgctcccgacaagccttcaggtactcctcctctagggccgcgtgggcagccttcagccgctggaagccctgaaaccagaccaggccaggaagacttgagtgctcagtccccgcggggcctgtccctgaagacacagtggatgagacagcttgcgggaggccatgggatgcacctgggcccctgggttcatgcaagatacaggctgaggttgagatctctggaggctgcctgccctggagagctgccgtggtcaagctctctgccatcaggctggcacaacagagacacaactcagagacttggcaccagctccagagggcaccagcccttcctgcatagacttacaaggaccccaatgtaccacaaactgtcatagctgtcacagtgtcaaatacactctcactattatctccataaggaccctttacatgagagactctggatcctcattcttgatttgcaaaactgtgggcttcagaaaattagccactctttccccaaatccttatagactatcgacaccgataatgttatcatcaccatcacattattgagaatgtttactgagcattgaggctctgggctaaagcactttgcatttatttaatcttcaatataatcataatgagaggggtgatttatcatcttcatttaaaaaggatgaaactgaggcacagggaggtcacttaagttgatgaaggtcatggagtgagtgagttgtagagacaggatgtgggcccaggccctctggccccagagctcatggtcctagcaattctgctaggctcccataggaggatcacaggtaatacatggctaaagctgcaggaattggggttggtatcactgtcttactaccatccacatcccactcaactctgaggagagacagaagccaagcacaacctaaaacccattccctggtcacatctaatcttctgacagctctcaacttccctgtatatggggggattagaacagagagcaaaaaaatgaatggttttagtttataaggtccttggtcatccactggatgatattacatgatacatatgacacattttgtgattggaaaatgtacatgacatctatgtaaccacacaggaaatatcctgccataacatttttttagaaactaggtgttttgaatttgcctctccagaccttctctcagctcctctcccaccctgctctgtgctttgagcatcagggctgtctacctgctggcttctggttgggtctgtctagtgggagggacctatgagagatcacagggtgggaagagagagacttgagagtgggcacagctcccggctaatgctactacccggggattcctcagtctttgttgggtcccctgatgctgcccacacctttgctgacagttctctcctttgacgcctacactcccagacttgagagccccacctgtcccttaatgggaccctggctgatgcagcaggaatctaaattgtatttatgaccaccgttatctaaaactccaaattccaaaggatatacaccaataggactctataaagggtctcccctccagcccccactttttttaacagggtttccaaacttttggcaactattttgtaattttgtttaaaggcgataaaaaagaaaaggcctttttctgcttgctgagaggcaggataatttgtggaaagtagtgcagggcagtgattatgaccctggatttgaaagagagacagacctggctccaggttctcctgcctactagctgtggggcctttgagtcacccctctgagcttcagttccatcctggttaaatgagggtgataaatgtaactgcttcactgggttttgatgatgaccaaataaaataacatactctagggtttaccacagtccctgtacacaaccatccttgcttaataatgggtaactattgtgaaataatgatcgttatcatgggaagctactcaggaactgtttgctctaaaagagaccctgtgtctgggattctcttttctgtcttgcagcaaagaaggcttcagagacagagtcatgggagacagtggttgtctggcagttccatgggtggctcctgaattgggcagtaccttgacttggtcctggggcatgagacgtcctgcctgtatcagtctttcaaaggactccacctggacattgggaggggaaggaaatatgctccattaatccagtcctgtagactcccacacccagccacatctatgccttggtaagaggagctgggtccgtcctcaggatgtggggtttctgccaagcatggagacgtgggtgctgggaacagcttctaccaccagccccaggcatggtagccttgagaaaaattgaagtgaaacctgcaggaatttactgacaacaaagcaagtcactcatgtgcatcaagactaatgagtcaggatatttactgcagcatgaacagtagggaggggacaagaaattgcctaaatgcctgtcggtggaatagtattcagccatcaacaagaggaaggcacacgtgtatgttctgagctattaatgcctccaagacctatttttcagtgtcaaatcaaggtacagggcaatgtttacggtatgctaccatctgtatagaatatgtggagagtaaaaaggaaaacgataaatacattgcttatatacgatatactatctctagaggaattcaagaaactaaaatatgaattgcttctgggaaggagaactgggtggctggaagacaggaatgagaagtagatttttctactacatgtcctttgcatcctttgaaatctgaacaatgtgaattcgttgcctacccaaaaataaatattcaaatttaagacttcaaaaagtcaaggtacagtagcttatgcagccatttctataaatgcaagtgtgtgcattgaacatttttgcatgggttggaggaaagatttagtttttgctcaatatgccctctgtactgtgcaaaggtccttatcatgggcatctattacctgctcaaaaaagtttaattacaaaaaaaggcaagggatgatgtaaggttcggttttaagaaagctctagatcagtgtgaaatatagaaatgtatattatataatcatattacataattttataatatataaaatagaactataatgtgagctacaccatctataattttctcatagccacattgagaatgtaaaaagaaacaggtaaaattaatttttatattttatttagccccaaatatcatttcaacatgtaatcaatactaaaaaaatagggagacactttatatttctaagtctctgaaatctggcatgtgtttcatacccacagcacgtctcaattcagagcagcccatgtcaagtactcaacagtcacatgtggccagcagcttctgaattggaccgtgcagcactagacatgaggggtcagctaaggccccagctcctgctcagtgtgatgatttgacattgctttattttgtggacaacatataggacgaagaagaaatgtgtctccggctacggaaccaagaatggtggtggcaaaaggaaacgaagcctgtaatcccagcactttgggaggccgaggcaggcatatcacctgaggtcaggagctcaagaccagcctggccaacatggtgaaaccccatctctactaaaaatacaaaaattagccaggcatggtggcgcgtgcctgtaatctcagcttctagggaggcttgaggcaggagaattgcttgaacccgggaagcggaggttgcagtgagccaagactgcaccactgcactccagcctgggcaacagagtgagactctgtctcaaaaaaaaaaaaaaagaagaaaagaaatgaagtacttgtatgtgctactccaacaaggattaactttgaaaacatcatggtaagtgacagatgtcagacacaggacaaatattgcgtgaatctattgctatgagacatccacaataggcaagcctataaagacaggaagcagaagagcagccgacggaggctggggaaagaggggatggggagtgactgcctaatacagatgaggtttcttagtgcgtgatgaaaatgttctaaaactgactgtggtgatagtggcagaactgcaaatatactaaaaaccgctgaagcaagcaaacactttaaatgagtcaaccgcatggtatgtgaattatatttcagtaaagcaagggaaagaaggagagatgggaggggagggaagaggagaggaggggaggggaggagagaagagaagaggagaggggaagggagaggagaggagaggagggaagggaagggaagaataaaatggtggtgcttctgaaagaatttgttttatgggcatggtagtgcatgtaactattgcatttctcttttggcattggcaactaggaagctcaaagctaaatgtgtgactctaatgtgcttagggtccaacagaacattttatttactcactccacgtattttatttttttctacccttacttcctctctgccccagttttctcacttctgttttcagaatgtggctaaaacgtatgtattttcataaggtgctttaaaccacttctggaataaagccaatgtacagttataaacagacctgcaaacaattcacggttacttggactgtttcatgaagatacgaagacccttgagaagtaactaggaattgatttatttaataaaatgaactaagaaagtgaggcaacttatcctgaagaggaaaaggtagagtggagattctgttacccttccagaatcctgaaagagctcagagtttcccgggagccagcctagagacacttccaagcacaagtggagggatttggatgagatgcattgccaaaaaggggggtgagacctagcactggtgacaaggaggaggctggagctgtgtggcctctaaaaccagggaggggctcatgttttggggatggctgagttaactcggtgcagaggcaggggaatgacaagtgagactcccagagtgcctctcacccaagcaggcagaggttctgtgttctccaggtgagttaagtctctcgggggcaaagctgggagtccactcaccttggccaggaactggctggcctgagaagccagtgcctgggtctgctctgctgaggactggtcctcagagatgtcccggttctccggaagccaccccagggtgggcatgctggtaagcgaggaggggctcaagtctcctcgagctgatggccaccctggaatacacaactgctgaaagctggggccaagaacagtccttccaggagctgaaggactgaggctgaacgtcaaagccaccacctccatcatcaagttatagctcagtcaccatgtgcgatcttcacatcagccccaggaagtgggctgggtagaacattgtcccccatttacaagggagaacaaggtccagatctgccccaggccacatggttggctggagcagagctacgctaggcctctgggttcccagtcaacagcgtgggctctcacacagggagacgtgagttccaatccagacacttcccctccatagctgtatgaacttcagcgtgtcctcacctctccaattggtccccttggctgtcatgggtgtgacaacagtgcacacctcagcgggttattgtggggattaagtgaggtcacatgtgtcaaggcttagcacagggcctggctgagatatgggctccccagggacaatgctctatgttttcaactcacccagggtcaccaagatgccaagtggcagggccagggctgcccccaggctgctgtggatcaaagcaggacactttccacatctctgacccttttgagtcaaagtgcccagggtggggccttgcctccctccttcccctggcctgaggccagcgccatccccagggtgaaccaagtcagtcccacagagcagaatcccaggcagaaggagcctccagctgcagctcttctcccggactcacctgaggccgcagaggcctgggggtcctcggccgggcccggccaccactctgcagagcggggctgtgggatggtgaaggacaagaccttggtcccctggggcaccattcccgtgtggatgctgtggttgggctggggtgggtcagagaacaggttcacctgtggaagcagggaggcacagcacagccaagtcagggtaggggcaaacccacctgaaacgcctcatcttcattcaggagctcaacacacatgccctgtagtaataaataccatctttcagtgcagcccttggctaggccaaacacaggtgaagaactgcatgccttttcatttactcttaatggcagtcctgaaaggaagacagggtggggaccccaacagcccattatatagaagaaaaaactgagacacagagaggttattaagtcagttactcaaaatccccagctgataagtccttggatgaggatcacaacactgctctatctgaccccaacacctatggttctcctattaacagtaattttttattaataatgtgtgttataattatatcataattaatataccatataacatataattatttcttaacaaatataagcatttctaataattattatactgataataatagcaactaatagctattcgaatgaatgagtgaaccagcaagtaaacaaactaatctgccattggtagcggatctctatcatttgaggatggatttaacatggcagccagcccagttggtgagggagcagtctggagtcaggcaggtgaccaaggaaggcctcttgaagctggaaagcagagggaaaccacaggctgttcaacagcttaaagcagagttgagagaactatgttctgtttttgtaaagaaggttttattgaacacagccatgcctgtttgtttatgtgttgtctatggctgctttcacactctggtggcagagttgagtagttgtgacagagactatatgctccacaaagccaaacattgtcacaatctggccctttacagagaaagtttgccaactctggcttagcatgtgggctctgcagctagagcccaggttcctgtctaggctctaccacagcacacctctgagtcctagttggtttaataacctctctgcgcacaaaataagtgctcaataaatagtggccaccaccctgacattcatcaccattatcttcaccaccaccgtcatcaccactaccatcattagcatcaccatcagcatcaccatcagcatcatcaccatcagcatcatcaccaccactgtcattaccaccaccatcatcaccgtcagcaccataacaatcactattaccatcaccatcattcaccatcattaccatcaccatcactatcaccattatcaccaacaccatcactattaccaccaccatcatcaccatttttaccattaccgtcatcatcataaccatcaccgtcatcatcgtaaccatcaccattatcaccatcaccgttatcgtcatcaccatcattatctgcacagccaccatggagacaggcccgtggaaaagcaacaccccttagtgggatttgctcatcatgatgttggggggttatcttaactgcccccactgcaccaaggtcaggaatgagcagtttagggtgggcctggtggaaggggctccctggcccccaggcaagcaggctctcttgcttaagctgtataggtcccggctgtagccgaaaaatcaactccaagtgtggcatggtccccgccgcctccccctctttcaggcccagcctccccagatgagaacaaagctggattttaataatcccctcagccatctgctcagactcccctgtgggggcctttcctatcagcacccctctcctgaggtgacccaaatcccaggggaggcccagccctctgacatgtttccctccccagacccctctctcagcctcaggccccacctagggagtgacagggaatggggatgggccagggaagccaggaagcccttttgtttcagggaccgataaggagtttgaagcagagaagcccaaaacctgagcagatgcccaggcagagcgatgaggtggggagtggcggtgggggtgggggtggcagctgcagctgctccggccaggccctcccagggctggtctctctggacacagccagggtgtcccgggtgctccccaaggctggattcactcccttgggggattctgtgaaaggtgaatcaggattctgtgaagggaggactagtgaatttgggaaacattgggttaaacaaatgaatattctctgcacagatggatttctctcagcctttaaaatgctaatgggctttatgaatggggagggaggggaggaggaagagagagaggaagatgtttccccaactcatctgcatacagaagcctccccctccccccatccccacccaggggcttctagaccaacttgcagccatcagaacacactgaaaagaggtggttttacatcatctccgtaattccttcttgggtaatttctggtcacctcagctcttccagatccctcttcagctgagatggaggaacaggggctgggggggaggtggcaacatggcagcaaatgcagtgagatcactataaaccctggccagaggccagtgtagagaacagagcccaccagtgactcctgaccagtcctggctccctgccccacagctgggctccctggtcctgccccaaccccaaggctccagacccatcggtgttcctgggccaggcctccccagctgcagatcccgcaactaccaagtctagttctgctagagtgtggtgtcactcgtgggcttcagagctaggctgccgagttccaactcctgctctggcacctacttgttgaatgatcttggtcaagttatttaacctctctgtgcctcagcttccccaactgcaaattatttaagagagtggtccataaacatcacctatgaccattcttattactataacagtcatcaatccacctcatccctatgcctgtctccacacccagtgccagggcctgagtgccagggcttacccaggcatgaggaaagaaacacctgttctggaatcagggagatgtaggtttcagtcccagctttgcctgttgcaccagctgtgggatgttgagcaaaccattccacctggctgtgccttggtgtgtgtgtggaggggctcaaatatgaccctgaagctggggtgggatacctgttgctgctcagtgaatgtcaatctccttcctatgggtccccatccattgctgtccacctacccaccatgcctagcctgggtgtccagcgcaacatccccagcgcggctccctcccaggtgggtccagccctcccccgtgggctctgagcagagtgaaatggctcggtgggttctgaggactgcctctgaactcgtgggttctgagcagaagaccatcctggggtctctccagccttcggggtagagtgcacagaggtccagatggagtgaggcactggccagctggaatctcagctcccctcaagccccatggacccagagtgaatcccctccctgttccggggctctgtgttctcttctgcacataggagctgcaagcctgccatgtactgttccttcagggcagctgtgagatggggttgggcaggagatgatagtatcatcctgcttccttccggtagagccctgaatggtgctcacacttcttgaggctgagagaggggttgggggagggagcagagccctcgggccaagcaatcatttttccagaaagcgggagtgagtgagctggcacagaaccatttctggcctctcctgtgacaccctcacacacatgagccaggggtctgggtgctggccagggcagggtgactacacatgggggggaccctgagtcctactgggtcaagggagcacccacgagaggagataccccagctgtgctcccccgtgtccacccccgcctgtcactgtggctggcacacaagaggcctggcagtaaacacctttataatattccctaactcttacaaagtgcctgcctagtgccaggtaaatgctttctgtatactgactcatgcccttaaacgagtgcaggaggaaggaagggaggagggagggtgcagacgctccacgcctccagcccccgccactccatgaccttcagaggcccctatcccaacgggagccccagtttcccaatctgccaaatggggaagcccaagtgtttgggtctgatgaccagttcctttctccttggacctacttggagtctgcagccatgggaatgtggtttccccagagaggatgacctaacaaagccccttccctccctttcccaactcccccgtctcttccaaccctggatctggctcagtggttcagaaagctggaaggagcctgcttggctcccaggaggaagtctgattagcccctcttttacagatgtgcccgatgaggccaagagggaagggtcctgcctgtgccaggcagcaggtgtggggacgcagcggggggggggggggtcctggtcctagaacaggcccccttccatttcctcaccacagtggcctccgcccacctgccccggaagtgcctctcgacattgagagcagcagctgtggcaggggcagggtcctggagcatgacagggggaggcactggggcatctgcatctctgcacctcagctcccacatcctcctctactgctgcctgatgaggcaagaggagggcacagcaaaagcaggaagccacgaggggccgcacaggtcccacttcctgcctcactcagaaaagaggaaggtgcagaattcacagcctcctccgaagacggggtgggggctggggtggtgggttccccctctgctctcctcctgccccatactgctgttcaggggaggggagaggctgtggtgaggtggtggggagggagaaaggcaaaggtgtgatccaggaagattcaggcccaaaaaacaagcaccaggggctgagcagaaattctgtgttactcttttgaggctcacagagcccaagtaacgtccttaaggtcacacagctggttagcaatggagccaggagtcgaacccaggtggtcttactccagaacccatctagaaggagagagattctcatgaaattcctgggctcatggtagctcaggcctgtaatcccagcagcactttgggaggctgaggcaggaggatcacttgagcccaggagttcaagaccagcttgggcaacaaagtaagaccccgtctctacaaaacattgaaaaaaaaaaaattagcagggaatagtgatgactgcctgcattcccagctaccagggaggctgaagcaagaggatcccttgagcccaggaggttgagattgcagtaagttacgaccatgccactgcactccagcctaggtgacagagcaagaccctgactcaaaaaaaaaaaaaaaaaaaaaagcccagggaaggcaaggtcactgcccaaggtcacagagggaccttggggtagaagaaaactggcgttccactatctccagggcctcagtagatggaggaggcagtggcctttctctaggactatggaaaagtgtcacctcctcggggacttgggcccatgcctccaccccatcccggcctggtaccttggccccgaggcgtagctggtcaatggtgttctcggcctcagcgtacttggtgaggagcctgtggtagtcttcctgcagaaagcgggagcaacacggtcacatgcgcaggcacacaatgaacccctccttgctgggagaccctgatagcaaacccccttccataagggcttctgggttcctgagaggaaagcattcaatggtgggatccgagctgagcaatcttcaggcttgtgtgcaacacagacccaccacgttcaagttctggagcatgagagggcagtgggacaactcttctacccccatgacaacgggtctagactgagggcctctggctggtttaccttgatacataacccatgtcgcagatggctgccactgttttatttctccaaatgccctgcccaccggttggctctgtggggtgaggcccatatctttctttccccctgctgcactgtcggtgtttaagaagcatgtgcttaagaagtacctgattttcaatggctaattgaatgaatcacccaagagtcccatggcagagaaatagaagacttaaaatcactgttccacctactcagagtcacttatcttaaacaagtccaaagaactttataaaaacaagtcattgcaggaaaaaaggaaaagcatgtcacctttgaaggatgtgaggaactgactccttctgaaaacgggtcggtaactaagtaagtaccattatgggtcagtaacggtaacagtaaaaggacagaacggaacatctcgctggcccttcccataggaacaagaacttggtaaccaagtagttgatgagggacacttttactttttagcatatttccagcaattaatgcaggaatgagagcattagcatactaccactttgtcacctcaaatgaaagactagcccaagacaatgaccatcagaggctgtcaaaatcaccaacaagagagcagcaggcatcctgtgcttactgaaggaggcactcacgtgctcttgccaaaactccccacgcccgtggagctcatggtctggaagggaaatggtcatgtttctcctccagaccaccaaagcctctagctcaaaacctaacaatattcaagaaaaagaggacaatgggacgcatgaaaagagaccacagcacatcagcaaagcccagactgcggacgactctgcaggacagactgatttccgcaacaaatgaattgcacggcagaagtaagaaggaggacggactaagagagtaaaagagatctgaaaaagtaaatgcaagaaagaaagaaagaaaaagacaaagggagaggacagacttgaaaggcaccaaatgcaatatacaagccatgtttggatcctgaggcccatggacgggaacgaataagccatttatgagacacagagagatctgaatgcgggtgtgatatttgttcatatttaaggacctggtgttaacatttaggtgaccatggtatgtggttatgtttaatataaggtctttatctttagacatacacacactaacacatttttagataaaaggattggatgcctgaaattttgcttcaaaataatctagtgggggtgaataggggagaggtaaggccacaggcgagaaaggttttcggggctgctaattgtggatgcggggggtaggtacatgggagtgtattctacgatcttctctcttgtatatgttttaatttttttatagcagaagttgaaaagaagcaaacagatcatccttgaaacacgagtacaatcactggtctttttgagcaaagggcttgggtgtatctcagggctccaggtacaccctccctccaccagcagggagttcctggcccaaaccccaggcctccctaccgcagccagcctctaccccagggcttcctgcccaagccagcctccaccccaggcctccccaccccaccagcctctatcccagggctctccacctcagccagcctccaccccaggcctccccaccccaccagcctctatcccagggcttcctaccccagccagcctccaccccaggcctccccaccccaccagcctctatcccagggcttcctaccccagccagcctccaccccaggcctccccaccccaccaggctctaccccagggctccccaccccaggcctccccaccccactggcctccatcccagggcttcccaccctagccagcctccaccccaggcctccccaccccaccagcctccgtcctagggcttcccaccccagccaggctctatcccaggcctctccaccccagccagcctctactccaggcctccccaccccaattagcctccaccccaagccaacaggggccttggtgacacatccacagccatgagtcccactaacctggagctgatggaccagctcagtggcttgctcaggcgtctgaaattcttggggtaccctggtgatagggtgggcaggaggcgtgtcctttgccagggctgcttctccactgctcaacagcacctcctgcacaatctcagctggagacttgaagatgaggggcctggcaggggcctgaggcttcctgttgtggcttctggacttggggggacggtagctctcatctttggggaatctcacccggggccctaccttggagaaatcagggagtgggtagttcaactgcccccggccatacttgggggcattagaagaggagcggccagccagagtggctccctgtctgggcagcggcctgccctgccgcgttggcctgggctggggattcagggggctgatggagccaatgaatcgggaagggagtggcttaggtgacgtctttgtctgcttccagatgtgttccttgggctgagggcagaagaatctggtcgtttctctcctccatctatctgtggcatgctgcggactctgggctgggggagctgaggagtcctggaattccatgggggttgcccgagcaacactgcctccagttctgccatctgggcttaggaggtggtggctggggccctctggcaaggtttctgccagggcagtgggctgggggccatcggtctctccttcccaggtagaatcaaggctgtcactagggtggtcgaggctcactgtcccactgctccaggaccttgccgggctgagttcaacggatgggttgacctcggaatgttcagaaagtttgtccccactggcttgttcgccagaagccacccagcccctggcctgaccatgcccaagagccatggggctggtgtttccatggccttccaagctgagaccagcctcataccccaaccttgaggagctctctccagcctcctcaacctccagacttccgagggtcccatctggctcctcttcagtcatgtccagctgacggccctgctgggggagccaggcaagaggctcatgggaacttgctgggctgtccacatcctctgcttcagcctctggaaagacaggccattcacttcttagcatataccagctctgcacccaccttgtaacttaccctaagtcacttcaactctctggcttccatttcctcatcacgtggggatggaaagaatcccaaggtggtggtagacttagccaagtgcttgtctgatacctgatctgattatctcagaggtccttcaaactcaaactcaaacccaaacccggtggatggtccctccagtgtctcccatctcagcagacggcaacaccatcccctctatgcatacaggccagaaggctgggaggcatctttgccatctctctccctctaaccccctgaatccattctgtcacttggtcctgtccaatgggacctcctataaagatcgcaaactcatctactgctctgaagtctaccaccactaccttagctcgcgtcccatcctctcatctggctaactgcagtcagtagccacctaaccatctcctctatcctcacccacatcccacatctgaaaactcatccatgtcttcctgtggaagaaaagcagaaccttcactatggtcctaaggtcgctgccaccccggccccattagctctcctgatccatctctctccatggcccctcaagctccccctgctcctgctatgtgcacacaacgctcctcccaccatgggggctacgcatgtgcgcatccctctgccgagggattctctcccctccttggcctagttaactcctatctgtccttcaggcgttcgctcaacctctgcctcctcaaggaagacttagctctccctgactaggtcaagttctcccttttacaggccctcataggactggctccctctactttgtaacacttatcatagcagcagttttccatttatttgtgcagttgtttcattgacatttgtctcgcccactacactgcaagttctatgaagccaaggatgctctctgttttgttcatgattatatttgcagtgccggtacctgacactatttgttgactaaacagaaggaaggagaaaagggaggtgagtgaggaagagagggaaggaaggagggagagaggaagataaggtatataaagcccccaggaaatagatagttattgtaattattacatagtgggtactcaagaaatatttatccatctacccacccatctatcccgccatccttcctcccaacatccatccatctacccacccatgcacccattcatcacccacctgtccattcatccatgcatctaaccaccatccatgcagtcattgtttatggagcacccactctgctctagaccccgtgttgacctcagggataagtccaaagtttcatgagacatagtttgggtaccaccaggcatagactctctgttcaggcagatgcacctttgtcgcactctctgttcctccatgctctttcccctacccttgatgcctctacgtctcttaaccacttaacatgtccttcagcaagttactcttgcttacagcagcatacttgaagcccagggaggttacgtaagttgccaaagatcacccagtggttccctggacctaggacccaggccccagccatgcaggtgagtttgcttccaccactaggggtcacgtactaggggtgaaggggcctgggctttggagctagggagccctgggttcaatcctggctcctatcacccctcactggggccacgggcaagctgctgacctctctggcaatccatagtcaaacttgaggatagttcctcctacctgacagagggtggtgaggagggaacaagagagggccagaccctgcccagccctgtgcctggcacatagtaaaggcacaggacaaggtagcagctgttacatcatagcagggggttaccatgtgaccccaggaagagatgcctctgccctgtcgacccagtgcatctcagtcaccatcccctgctggagagagagctcagaaatggctcctcagtgggcagtgcccactttgagcagatcaggtgtgtgaaactttgagtaatggcacaatccactaccagaggaggcttctctaccaaccacaccagcctgcgggagtcacaggaccctaaaacaggggcatcttgctcataatctaagtgcaatagttaccatatattcagctcttactattctccacgatatgattcctctcattttatagatggaaaaagcaagattcaggcagaaggaacttgctaagcaaagctaggaattcagtctaagttggtctggatgcaaccagaacacagctattgtagaaaacaagaaatgccaacgttcccattgctaattgggattttaaaaaaccttaaaaatgtccaggcatgacggctcgcatctgtaatcccagcattttgggaggccaaggtgagaggctcacttcaggccaggagtttgagaccagcctgggcaacactgtgagaccctgtctctacaaaaaatacaaaaattagctgggtgtggtggcatgcacctgtagtcccagctcctcgggaggctgagttctgaggattgattgagccagaaaggtcgaggctgcagtgagccatgatcatgccactgcactccagcctgggcaacagagcaagactctgcctcactaaaaaaaaaaaataaagtcaaaaatggacataaccccgggactaagtaattcaaattaccaaagatatgatcaaatcaagtgtgcaaagatatattaatgacattcatcactgcattatttataacagcaaaatctagaaactactaaaacgcccagcagtaggagactggccaattaaccatggaatatccatggaagtctaggaatcacttgtgggagaggatttgatgaactacgaaaatgttcacatctattaagttaaccaaaaagcaggttacaaggaagcatgtagaatactgttccttattcacattacatttgcatatctacacatatggaaaacagtggttatcaggggatggagtgggacaatgagtaattttaaattttacctaattttgtgcttatactttccggttgttctgcaatgaatggtattatgtatacaatttaaatctttaaaaatttttaattacagactttgtagaatttaattgaaaatgctgaagcagcgtccactcccttcctccctggaagaatgtgtgatggccgggcttatgcctgtaatcccagcactttgggaggccgaggcgggcggatcacgaggtcaagagattgagaccatcctggccaacatggtgaaaccccgtctctactaaaaaaagaaaaaaaaaaaaatacaaccgggcatggtggcgcatgcctgtaatcccagctactcgggacgctgaggcaagagaatcgcttgaacccaggaggcagaggctgtagtgagccgagatcgtgccactgcactccagcctggcaatgaagcaagactctgtctcaaaaaaaaaaaaaaaaaaaagaacgtgtgatgttttggggacaggacaccactgtagggggaggggtgtcagtctcaccttctcccgaagtctctcctgactcggaatcctgatgcccatcgggctgcgggtgtgggtcccactccaggggcggcaggtgctgctgggccaggcggaagtcctctaggagctcggggctggtggcattgggaaagagtctctcttcttcccagctttgtgaactacttctatccacatccctcttgtcctcggcccaggcccagcgccgccgctgggggcccttccccaggccaggctcagcccagcggatctcagtctccgagctggccattggggctggcctgggcttcacctgggccacttcatcttcaggagacagagctgctgccaggggccccagagtcaccgctggttcctgtcagcatcggccatcctgcctgtgccctgtcagggacacattcaagagagaacattaatcaatcctgatcccctcttttattcggaacaagaagttaccagcaggaactctggaattagccccagttcaactcctggttgtgtcctcccgaagctgtgtcaccttgggcaagtcactctgccttcattttcttcatcaataaagctgggataataattcctctctctctccagggtttttttttttttttttttttttgagacacagtctcactctgttgcccaggctggagtgcagtggcacaatctcggctcactgcaacctccgtctcccaggttcaagcaattctcctgcctcagcctcctgagtagctgggactacaggtgcacgccaccacacccggctaatttttgtattttttagtttcactgtattggcgaggctggtctcgaactcctgaccttgtgatccacccgccttggcctcccaaagtgctgggattacaggtgtgagccaccatgcccggccccctccagggttttataaactagatgagacacaggatgaggagcccagtggccagtgcaccaacgaacaggtgttgaatgcatgctagctagtgttactgcgtactggctcttcgtgtgggcatggggcacaggccctgctcatgggagaactgatggcccaggaggaagcagacgatcaccaggcaactacaaatccaggtgagatgtgctggaggaggcacgggggctgccctgacacaggccagggaagtctggtgatcccagtttagaagccggttcctccaagaatcctctctgacctcactggggtaagaattcagattgagaggtgggggaggatgatgaaaaaagcattccaggccaggtaggagagctcacgcctataatcccagcactttgggaggctgaggcgagtggatcacttgagtctaggagttcgagaccagcctgggcaacatggtaaaaccttgtctctacgaaaaattagccaggtgtaattgtgcacacctgcagtcccagctactccagaggtcgaggtgggaggatcacttaagcccgggaggtcgaagctgcagtgagccatgacagcgccactgcactccagcctgggcaacaaagtgagaccctgtctcaaaaggaaaaaaaaaaaaaaaaaggtagcattcctgtacccaacataattgaaaaacaggtgctcaaatgaaaaggcatgaagtcccaacacatgctacagtatagatgaacctcaaaaacattatgctaagtgaaagatgcgacaaaggtcacatatagtgtgattctatggataggaaatatccaggcaaggtaactccttggagagtgaaagcaggctggtatttgccaggggctgggggagaggagagcgggcactaaatgcttgctgggtatgggatttccttctgaagtgatgaaaatgttttgcaactagatggaggtggcagttacacaacactgtgaatatactaaatgtcactgaactgtttacctaaaaatggttagttttatgttatgtgaatttcacctcaatttaaagaaaacgccttccgagtgaggagtgaggcgagctgggggcggggagcaagcctaccaggggctttcctggacctgggagtggtttcgccgccgatggctggggtattgaacacagggaaagcccatcagaggtgtggtttaaaagttccccttgggctgctctgggagaatgaaccagggaggctggccacacgggggacccgtcaggcggctgctgcaggaacagggtagccagagaagggctcctccgctgccttccctcaaccctctccttctttccctctttccttctccctctcatctccttttgcctcttccttctgacgctcctgctatttccctaagcgcttcctctatgccagcactgagccaggcccaggaagtgcaaagctgacccagagtgggcacggtcccccagggagctccctgccatggagggttcagagaactgcagcccatcagtgcagcggcccccagagcagctcacacaaaggccttcttccacagatggggaaactgggatccagagaggggagaggccttgcctaaagccacacaggggtcaggacaaggcaggggtgaaagtcagcctcctggcccacagtctgggctttctcccctgcatgctgtgttgaaggcagtatgactccaggcctcccaggacagaaggtctgtgtttgtccctttatcctcatgaacacttggatcctgcttgatttgtgtggctgagaaaagtcagcaggcaactatttttggacacaaagttccccagggaacagtgcagcccgggaaaggctgacttctcaagggctggaggagggaggtgcagggaataccattcttccctccttggctgcgactcctgctctgtggatgggtgttcggggcttctatcctctgtccccgcccagtcttcctctctacccccaaatgcagagccctacaatttcctccagatcaccctgtgtattgtcctccagccccacagtccctaccacatgtgaagagcccactcggcgccagcctgggttgaagctttacttttaaattctcaatctgccctcctacaaacatgagggtagaatttggctaagatcacccagctacttcctgccacagcaagatttgcaactgtcaattctggcctagtggtaccccaatatttttttaatcacacaatccatcagtaaaaatatatttgctcgaacacatcacgctaatatattacatgtattggaaagagtattttcaaaagtgatcttctaaaaagatgcaatcgaaaatgggccaggtacagcggctcacacctgcaatcccagcactttgggaggccgaggtgggcagatcacttgagctcaggagtttgagaccagcttgggcaacgtggcaaaagcctgtctctactaaaaataaaaaggaaaaagaaaatatatacaggtgacccttaatgacagtttgaaccacacaggtctacctatatgtgaattttcttctgcctctgccacccctaagacagtagatcaatctcccccttaactcctcctcctcaatgtgaagatgacaaggatgtaggcctttatgatgatccacttccacttaatgaaagtaagtagattttctcttccttatgatttccttaataacattttcttttctctggcttactttattgtaagaaaacagtacataatacatataagacagaaaatatgcattaaccaactgtttatgttatcagcaaagcttccagtcaatagcaggctattgataaagttttgggggagttaaaagttataagcagatttttgactgcatgaggcactcctaacccctgtattattcaaggatcaactgtattttattttattgagacagggtctcactgttacccaggctggagtacaatggcaatcagagctcactgtagccttgaccacctgggctcaagcgatcctcccacctcggcctcctgagtagctaagaccacaggtatgcgccaccatgcctggctaattttaaaaatttttttttgtcgagatggggttttgccacgttgcccaggctggttttgaactccttgtttcaaatgatcctcctgcctcggcctccctatgtgctgggattacaagcatgagccacccacccagctggtcaactatattttaaatagaagctctaatccttgcttctcataccttctgcagggcctgtacccttcttggaaatccctgccagggatcttaagcttcagtgtgcttaagaatcctctaagcgtgcagtttcctgaaacaacctgcagagagcctgactcagtggccctgggatagggcccaggaatctgcattttaaaccagggcctcaggcagggcctgccctttgaagttcactaggcctcctggctcctgctgttatggcaggtggagaagaggctacaatttagctgttgcttttctgattctgaagcctctgctgaggaaggggccgggggaggtgtgcggttttttgactttttaaagggctttttttctagctctgccacagagcagcctgcccaatcacagagccctctgggtgcacaaagaggaacatcctgtcttctgggatgactcagtcgtggcagaaatctcactgtaaccaggggaaggtgcacgtcagaggcagctgcagtgactgactagagtttcgcacttgcccccaggcgcctaaaccagtgagcctttcctgagccaggcctctgccttccatgcgagccatggccctcctcaccacaaagccccagaactggccagtcagctagtcagtcaacaaacacacgttagtgccaactacctgccaacctcaggctgggacgatgctgtgatagagaagcaggctgggcatcaggagacaggtgctagtcctggctgctgttactcactgtgtatagctgggcttgcattttcctcactgtaaaatagagaaagtaccacctgctcttgatatcgcaaggggatatcaccctgctagggtgggttgggaggcagggtatgggactcaaagagctttgaagtccctgattgactcagcttctaagggcaacagcctcagaactgttaacctctctcctcctccctgaggtcacatttcaaagtacaaagatacatactgagcacccagtgggcgcaaattaactttttaaaaaagccctatgacttcctactatataccaggcgctacgtaagatgcaaagaatatagaaaagagtaaaagtgttccaagattttaaacggtggggggtagtacaatacagaagtgttaccaaaggaagctttaaggtgggcttgagaaacaatgaggatttgggggagaagactggggagggcattccaggcagcgggaacagcacggaggcaaaggcacgtaggtctgaaagtatggcctgaccttgaaggagagctatgggcaggtgtccctgcatgccagataaaggcagagttgttccagccagccctcgttagggcagcagggctgctcctaaaaggcagtgagtggggtttggtgaagactccagcagtgtgagctggggagggctatggagttcagggtccccgccatccctggagaaactggccccacaaggaagtagcagccactgcaccctccttctgcacatctccttcttacacccaagccgccactgcccctgctctctcaagggtctaacagacccctgaggtgtctatcttcagttcctgggtgggatggactcttcttccccaccacccacacagggcttctccgcccgctcagtcattccacagccagggacccttccctttatggctcaatccctcagaactgcccagacgcccaggctctcctttgccagcacagctacgcagcccgcacagcctccccgtgccctctgcagccccttcccatccagccagagctgtccagggtgccaccctgcttctacccccacccacaccctgacacctcccagatgaagacactgaggcacagagacatggcctgctctcacaagacctcacagccaggaagcgcagacagaggattcaaagctggggtaccgcaactctgaaaccaaggctgtcagatgtgtcagggagatggggaaggaagaccaccccccaaatcagtaaccagaccttccaaaaaggctcaaccatacccccacccacctgctggcagggcacagacttgctgttctcaaggggttcccaccagctgtgtggactctagtcccacaaggaagcaccagccactccctctctgtgtcctccctgcccccagcccgctccagcagcagaggccgaggagaaagagaaacggtgccctggctgttgccagctctggtcttgccatcctcaagagctgagctgggtctgctggtcctcggactgtccttggctcctctccttgctcttacgcagctggcataaggggccactccttcaatagggaccaccccccggcgccgtcgctgcctcctggcctgctgcccatgcctgcatcgtctctgagaccccttagcaaccaaggacactaactctccaggtgcagacgacgacaccccaggcacagagatggacccgcctacccaagttcacaagagatcagaatcagagctaggactggaatctagcatcctgaggcttgacgaaatcctccttaaatccacccttgccctggaggccgggatcccctaagccaagagaaaagcggtgcagctccagcagctgcaacttcctggctgggctggtccggctgcctggactgtcccggagagtctgtgactggcccgtccagaaggaaagcggcctcccgggccctcctccgttccaatcccttacctctctcgggctccaccaccgtcctgccgacccagtttcaggggacctgcctgtgaattctttgttccaaacccagggagccccctgtctccattgcgccctggcccacctccaggccgttctgccagcccaagctgctgctcacagaccagcatcgctccccacctctccccgcccctgccgtggttgaggccgcctcgcctcggcaggaagcgcccagcctgatttcctacaagtgtttgtcagaaggagggggtttgtctgcgtgcagagcaagagctggaggagcttaaccccttgcaagccctccgcagtcagcgctgcccaggaaaggactcagggaacaaactcctgacgtcctgggcttgggatcatctcagcccaggccctgcaggtacagatggggagactaaagcacagagaaggtcagaggcttggccaaggtcacacagcatgctgtagctcctaccctctaggccctcttcaaccacggcctgaccttagccgaggctccttccctcactaggcctcagggcccatgtgcacggtgagagctcagactcaacaccactcctgcccttccagctctgactctgccaatgtgcaacctgaatctcagggagaccgtggtgattcctgccatctcaacccaccgtcctcaccccgaggtggtcctgcagccagagtgggatgttcggggcagcatggaggtgtgaacctggcggatcaggtaaactttcccttgttgtaagaaccctccaagggttcaccagatgttgggaacagatcgatcctgatggtcagtcgagctatctttcctcaagccccaccatcccattccttcattcgtaggtactcactgagctcctactgtgtggcgggtgcttttaaatcacctgggaatatggcagggccgaagacaggccagtcccctgctctccactctagcagagacatggacaataagcaagcacatgtataatttcaaggagagagctgtgaacaatgagactgggtgacgatccgtgtcccaggccaggtggcactgaagcctggggctcaccccaggccaacagagtcagtctctgggcatcagacattttaagtgtcccaggtgactggccctggtagagaacacatggggccaagagtaatgggttggaggagaagggttataggacggtcaggaaggtctctatgaggaggtgacattcaaataaggcactggaaggaagaggggtcaaaagcaagccacaagaaggtttggggcagagtgttctgggagggcaagtggaaaggccaaggtgggggagccagcgggctttccctgagaacagcaaggcctgtgtacccggggcagagcgagtcaagcgggagaagcaggagcttcacagaaaagcgggcacaggagcacaagaggctcccaacactggccccacccaggacccagagactctgagtcaggaaacaaaaagaaagaggaaaaaaaacaggcctctgtattgtccaaaaagccctccaggtaattctgataagcagccagatttgggaaccacccatgtaggagagaaaaaaatctcagagtcactgtggacctgggttcaaatcccagccccatctcctgctggccctgacctttgaggcttcacgtctctaagcctcagtttcttcatctgtaaaacagggataagaagagtagccaccccacaggggctgctataaagattcaatgacatgatgcctaccaagggtagagcgggggagccagaacacagtcatgtattgagctattttattattgctactacaactattgctgctacttaggtataagtctctggtctcctctaaaggctagatcttaatatctttcctgaagcctggcacactgtttatggctgatgaatgtgttctgtgaatgaatgaatgaatgaatgagtggacgttcccaaggtcagcttgtgaatatctggcgtagccagggctagaaccaggagccctcatcctggtaatcgcccacccctctatcccctttcctgccttttacccacatctgggtggcagggctctccctgtagcccccagccccacatggagcagagccaaaccctaatgaggcccctccctatcagctctggaggccatgtgtgccattgtgcaaggggcgggctcccctgacaccctgtcactcactcaccctccctccctggtcattaacccaggcagcattaacccaggtggctgccattgctgggcatagcctgtggcccctggataaccccaaacccatctcaggggcagccacctaacaccaaggagaaccgcctgcagtgcagtctgttccatttccttgcacccccaagcatgaccaaccctcctccctgcctttgctcatgcactgccccctcttggatcactgtccccacccacaggccaaattctaccaaaccgaagcagcatgtctaagactgagctcctagtattgccaccctccaaacccacccctccttagtttggcccatctttcacccaggtacacactgagaatcaactgtgaccctggacacttccttttcccttacatcccataaccaatccatcgtcaactcccagtgatttcatttcctaaatttcaccagaatctgtccccgtttctgcatccccacgtgggtccctggatcggccttgcctggaaagctctagggtccactaatctgttccccacactgcaccgatgtggtcttccaagataaaagttccaaacaagacccttccatgcttcagacgcacagctagctactatggctctgagaaagaagatgaaactccacaagctggccgctgctgcagcctcttctcccaccaccctctctgcccttgctcagcatgctcctgccatacaggcctccttgcttttcctgggacagatgtgtcctgctcctcccctcacccagtcccacttcttttccctgttaacttctaggcaacctccagatgtcagctccagcgtgccctccttggggactccccatttggaactatatttcatatgtgattatttgattaacatctgtctcttcactcagttgggagctctgtgaggctctcatcatcatatccccaggacccagcacacaggccctgatatacaatagaaatacaataaatatatcctggatgatccactcaacctagctacttgcccaagcctgactcatagccctcataacaacccaatgaggctgatgtgacaaccccatttcacagttgggtaaacagaggcccctagagcccaagcagcttgcccaaggtcacaaaggtgatgagctgcagtagagtttcaaacacacaaagacctggcttctaataaccaagcttggtgctcacaacattgcagcccgcagagataattaatacctgtgcacaataaaatcgagagtggagcttcttaccaactaattgcaattcacaaagccaatgttccaattttatagtgaggccctggttccacacagagccttttggtttcccaaaatgctttcttctcctttatagcactagatgctcaagaacagaacgtttaagtggggagaacacgagtattattccattgtataggtgaggacactgaggcccagagaagagaagagaagagattcgttcctggtcacccagaaaagaaacaacaacaaaaacctctgactcctggccaggtgcagtggctcacgcctgtaatcccagcactttgggaggctgaggtgggcggatcacctgaggtcaggagttcgacaccagcctgggcaacatgatgaaaccccacctctactaaaaatacaaaaattagccaggtgtggtggcaggtgcctgtaatcctccctgtaatacttgggaggctgaggcaggacaatcacttgaacctgggaggcggaggttgcagtgagtcgagattgcaccattgcactccagcctgggcaacagagcaagactctgtctcaaaaaaaaaaaaaaaaaaaaacaccaaaaacaaaaacaacaaaaaaaacctcttactcctactgccagggcttgatgactttcacccttttaccagcaacagtcatgtgcatggctgtgtctgcagaaccctgccagcccttcccacgagcctgaggcacaagaatcacttgaacctgggaggcggaggttgcagtgaaccgagatcatgtcactgcgctccagcctgggcaacagagtaagacgcttgtcaaaaaaaaaaaaaaaaaaatccacagggagtctgagggaaagaggaggcaggtgaggatttccagagtgaaccaagaagaaatgatgaagcctggctagggaagtagagaaccaagttccagcctgagtgaccaggaataagcaccttcctttctctgagctttggaacctgcggcttaatgagattgtctctgaggttatcagagattatcttctaatgctaaacctcctggattctttattccatttgcccacccaggcagaaatgccatgcagacaggaggctgcagagcacaggtgttaaggcacatgggctttgtgggcaaacagagaactccatgttctcccttggaagctgtgtggccttgggcaagctgcttaacctctctgaatcccagattccacatctgtaacatggaccaataattattttactgggttcttgggatgacggatgagactatgtgccaaaagttcttggccccagtgcccagctggcacagaatgactgttcacaaataaatggccttgccttttccgtgaaacgccctacaacctgctccctgcaggactgagtttaattttcctcatccacagcttccacaatatcaaccccaggtctagcgatgagtcctggacacaaaaagggagaagcagttttcccaagtggagggaggtgctgacatttccctgtgaccctcttccctgcgacccttaaaccagttccagggctcactgacccagctagaaactctgtcctcactctgagtagttaaggagcagaacaaacagccccttctcagccaactgagataagggttatgaggagggtgtggccatattgaggaaaacacatacataaattcaaattcatgctcttttcaaagagtcaaacaaaccgtgcacgtgccaggaagggactgctaacagcaaaactatactgaacacctattatgtgtcaaataccttataaaagcctttccatggactcagatctcattatttaatcctcatactaatccaaggagggaaaaattatgatgcccattttattttataggtgaggaagctggtttgaaccaagctgtttgaatctggacagtataatctttttttttttttttttttggagatggagtctcgctctgttgcccaggctggagggcagtggcgcgatctcagctcactgcaagctccgcctcccgggttcatgccattctcctgcctcagcctcctgagtagctgcaattacaggcacctgccaccacgcccagctaattttttttttttttttgtatttttagtagagacagggtttcactgtgttagccaggatggtctcgatctcctgacctcgtgatccacccgcctcggcctcccaaagtgctgggattacaggcgtgagccaccgtgcccggccctggacagtgtgatcttaatcactttgcaactgaaacttgcaataggtaaaatggttggaaacaatagcagtgtcccgtaacaggtgatcattgaaagaaattgtgatagttccactcaaaggaataatattagctgccgttaacagtcatgctattgaagaatatcaaataatgtaaaaattttgttatgttaagtggacaagccagttataaaataatatatatctagtttgagtccacttaaaaaaaaaaacagtaaaatatggaggaagaggaggaggaagaaaggaaggagacaggataggaaaaagaaagagagagaaagcaaaagaaagagaaagacatgctttaaaatgtttacaacaggccatgcgccgtggctcacacctgtaatcccagcattttgggaggctgaggcgggaggatcacctgaggtcaggagttcgagaccagcctggtcaacatggcgaaaccccgtctctactaaaaatacaaaaattagctgggtgtggtgacgtgcacctgtaatcccagctactcgggagactgaggcaggagaactgcctcaacctgggaggcagaggttgcagtgagccaagatcgtgccaccccactccagcctaggcgatgacagtgaaactgtctcaattaaaaaaaaaaaaagtttacaatcattatcactaggtagtagaattataggcaagtttttttgatagggaagtttaccatttttccttttgggtatttttcaaatataacagttgctttaaaaataagaatgaaatgaacatgtactattcttaaaaacaaaacaaacgaataccacctcacctctgtgtggtgcttccttctgaccttgggcacctccgtcttcagttgcccctcctgtgaaaggcgaaatgtatcgttgggttctttgaggccctttacagctctgacatcctataacattctgtaacccccacaccttctcctcctctgtttaaactctaatacaatatgttgttttctgcaatacagccattatgcaacatgtgggaacacatgaaaatcactaaaaggaaaggaagcaatcagcgcccagcctcagccactttttgcatttggaggcatggcatgtgttgctggattggatcctcataaataattaggcatttaacagatgaagaaaggttcagagaggttacacaacttgcccaaagtcacacagcatgttaaggcacagttgggtctgtacccacaaataaagcattatcctccagatgaatccttagtgggggactgagtgtgcctcttagaccctgagacctcccctcctcagtcctggtccttggctgtggtcccaagaccccgaggagactgacagctggacatcccactctggccctgatcccaggctccttccccagaaaaagctgagctggcagtgggggggctggggggagaatgctggcaaggacctaggggctggtgtgggagcggcactgggcgcagaaggtctcactcggcaatggagctggagttcgcctgacatttggcaaggaagcccagagccaagatggaacagcaagctggggtgcaggagggagggaggagtgagaatgtgagactttgggggcaggaagcctgggtagatcagccctttgctgttttgtttcagaacttctctgatatcctcatctacagacagaggcttctccttccctcaggcatgcatgtgtaaagtaacaagataatgtgtttgtacgcaggacacactcagaaaatgaggagcttctgttagcctcctggctcccctggccaactgccgcacctcttccctatcacccaccctgacttaccccccaatcccttggcacaatgacaaatcttagggcaccatcctgtcaggtttttcccctgcttaacgaccatccgtggctcctgtcactttcaggttaaaggccagacattttggcctggaattc

SEQ ID NO: 20 - DNA, 18875 bp, Homo sapiens
caggctgcgcctgggatctctacactcgagcagacggagaccccagaccccattggcctaagtgcctgaacgttataaatcaaaagtattttaaatgaagctgacatgtttacatttaagttttagaaatttaattaattatcccagcactttgggaggctgaggcgggtggatcacaaggtcaggagatcgagaccatcctggctaacccggtgaaaccctgtctctactaaaaaaatacaaaaaaatattagccgggcatggtggcgggcgcctgtattcccagctactcaggaggctgaggcaggagaatggcgtgaacccaggaggtggagcttgcagtgagctgagattgtgccactgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattagccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcagtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaaggacagaggtgcttatctgttatttaataaactgttgtgtgtgggtgggtgtgtgggtgggtgtgatatgtggggctctctaaatccctgggccccaatagtccaggtctaatggtggtgctgtccccaacaatgctcagcttctcctcaaaatacatggtatctgggctgggcacggtggcttacacctgaaatcccagcactttggaaggccgaggcgggtggatcacttgaggtcaggagttcaagatcagcctggccaacatggcgaaaccctgtccgtaccaaaaatacaaaagaaattagccaggtgtggtagtgacacctgtaatcccagctactagggaggctggataggagaattgctggaactcgggaggcggaggctgcagtgaactgagatcgtgccactgcactccagcctgggcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtccccatcatctcacccctggaccactgcatcagctccagctggtttctcaggtttaatctccttccctagccctccccattcttcccattcagacagagcgatctttctgaagaaccaatctggttatgcctttccaacccctttgaaatctttccatttctctcctacacctcctaagtctagcgaacccctcagcctggcttccatgccctgcaggctccatctcctgccaacctcttcaacataaagtctggccactcccacttatcatgtgctccagctgcacagactttccagctccctgatacacccactctctcacctgcgctcttccctcttgataactccaatcattgtttcaagcctcaaattagagcaatgcaaattcaagaaacaaaccaagctggcaaaaacacaaaaaagaaaggaaaaaaaaagggtcatttctgttctgacaaggatggggataaggagactcacttgtacactgccaaactgacattcaaaatccttagtgcttttggatttgtcatgtttgggaggagggtttttaaatcatcggctttcttgaggttgaataaataaaagaaaatgcacacattttaggtttactgttcaattagtttttacaactatacgtgtgtgtgtataatggccaccacgatgacaacctggatcgttgtcatccacttcagtgttctctcatatgcttttgcagtcaaattgccctcttttgcccttggcaaccactgatctgatttctaaaattatagatttgtttgagctgttctagaacagaaccgtacagtatataagctcctttgtatctggcttcttttgttcagcatagtgtttttgagattcatccatggtgttatatgtatcaatagtttaactatttttattgttaagtaatattcctttgtaagaaaatgccacatttttatttaccattttcctgttgatgggcatttggattgtttctttctttttttttggtttttgtttttgcttttgtttttgttttttagacagtcttgctctgtcaccaggctggagtgcagtggcacgatctcggctaactgcaagctccacctcccaggtttgagcgattctcctgcctcagcctcctgagtagctggtactacaggcgcatgccaccacactcagctaatttttgtatttttagtagagacggagtttctccatgttggccaggcttgtctcgatctcttgaccttgtgatccgcccacctcggcctcccaaagtgctgggattacaggcgtgagccgtggtgccccacccttggattatttctaattttggctattttgagcaatgctgttatgaacattaatatgtaagactttgtgcatagcacgtggtttcctttcccttggatactaaggtaattttaaaagggaaattggctgctctctgacacttatcatcagaggaaaaatcacaatatgaaatgctgttagataggctgggagtggtggctcacgcctataatccagcactttgggaggctgaggcaggaggatcacttgaggccagaagttcaagaccagtctgggcaacatagtgagactctgtctctacaattttttgttttttaaatttaattagccaagtgtggtggtgcatgcctgtagtcctagctactccagaggctgaggtgggaggattgcttgagcccaggagtttgaggctgcagttgagctatgattcataccactgcactccaacttgaagagcctgaaaaaaaaaaaaaagtgctgtagacataaaggacatgactaagtaggttagaatatagtaagcgggccaggcgccgtggctcatgcctgtaatcccagtactctgggaggccgaggtgggcagattgcttaagctcaggagttcgagaccaacctgggcaacatgatgagacccccatctctacaaaagtacaaaaagttagccaggtgtggtggcacgcacctgtggtcctagctactcgggaggctgagctgggaggatctcttgagcctgggtggcagaggttgcagtgagccaagatcccaccactacactccagcctgggcgacagagtgagatgccatttcagaacaaaaacaaaaacaaaaaaagaatagagtaagtgaatgaaaagttgtgcatccattacacttttatttatttatttatttatttatttttgagacagggtctcttgctccatcatacaggctggagtgtagtggcaaaatcacagcttactgcagctttgaactcctgggctcaagcaatcttccagcctcagagtccagagtagctaggctttcaggtacatggcaccagacctggctaatttttttgtttgtttgtttgttttccttgagacggagtctcactctgtcacccaggctggagtgcagtggcgccatctcagctcactgcaagctctgcctcccaggttcacgccattctcccatctcagcctcccaagtagctgggactacaggcgcctgccaccacgcccagctaattttgtttttgtatttttagtagagatggggtttcaccatgttagccaggatggtctccatctcttgacctcatgatccgcccgcctcagcctcccaaagtgctgggattacaggcgtgagccaccgcgcctggccgacctggctaatttttaaatatttttgtgtaaagatagggtctcactatgttgcccaggctagtcttgaactccaggactcaggtgactctcccatcttgggtccattaagcttttaactacaaactacactgaaatatgaaagttattcagaatgaaatgaataagaatgcaaaattataatcataccgtaagaatactttctgagtaatcccagcactttgggaggccgagacgggtgagtcacctgaggtcgggagttccagaccagcctggccaacatggagaaaccccatctctactgaaaataacaacaacaaaaaaaattagctgggcgttgtggagggcaccagtaatcccagcgactcaggaggctgaggcaggagaatcgcttgaacccaggaggcacaggttgcagtgagccgagattgagccattgcactccagcctgggggacgggagtgaaactccgtatcaaaaaaaaaaaaaaatgaatactttctgaaagtatttattcatacaaataaagacttgacccgtgaggtaggaacacaaatgggccacggaatcactcattccacagaatataccgagtgcccttgaagtgctgggcactgctccaggattgggggcgtattggtgaaagagaagcaagctgcctgctcagatggcagggaatgggggaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacacagctgttgccacactcagtggaactgaatctatgtttgtcttccccggcatccttcaccccaactctccccgccacaacatacatcccatgccagcctggggaccctcaaaggtggcttcatcattaggtttgtggctgggtcccactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcggacccccactcccggctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccaggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaacggagaaaggccctgacagccacggtctgtgtgaggctcctgagatctcatgtacagaaagtgcttggcgtggagctgggcatgcagcaggggctgggcacacggtggcccaaaggagccctgggccttcactgatgggctgtgtggccactgacacacctaggcctcctcacctgtaagacagacaccattgtgccatcccatgttctcacccagaggctccttttctcttccagtgggaggccaagagcatttcgctcacttgctgatcctcagggacaccaagacctacatgcttgcttttgacgtgaacgatgagaagaactgggggctgtctgtctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccactcatttttaatacccgtgcagtggggaattgatactgtggttttcaatgtcacccacactgcagcacggccacagtcaccatcccgatttttgctacaaatgaaaattactttataatgagctccttaacacttttctttaaacctgtgtttggaagacttgcgttggtgtggccctgtgcccaatacctgtgaaatcacagcaccgatgagctggttccaatttttaaaatatatacatgcagtacttccatgactattcaaagaaaaacaattccttccatttgccatctgagatgaccaccagtggtgtgaactacctcctgcccccatctgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccctggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagttcaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggacgtgtcctcagggtgctcacctgggagacccagaagaaggagacaacacgtaagggtgaggctggtccctggaaatcagttgacatcttgcaaatgtggagccctgaggtggagccaagcccgaggcacagcccactcagtggcacaagccacgaagggccggcctcacccagacctgggggctcatgattgacagcctcttgttacgtgagggaagcagcactcctcccgtggcagaaaagttgggcctgagttgttccatctattccgtatgtgcagctgcgtacaccatacagggtgataagaccatgagcctgaggctctgacaccccagggtccagtcctgtgtcctcaggcaccactcccctttgtacctcctgtcccaacagccaagctccacagggccaagactacagcatcctttgctcagcacccaaaccactgctgtgcccacagcacggaggctggggacaccgagctgatgtcctcagaaggcaagtggacaggacagcctctggggtcccacagtggcctggaactgaaggctcagaacctaaaagaagtttccccatttcaatgttactttcagtaagacaccattttcaaccatactgaggaggatccgctgaaaaatgaaacagaaatgagtcgtgatgggcagggcagggagaagcaagggagacgagaagtggggaacatggaaggaaaagccacgtgaggaagaaaccagaggtcaagagaaaaagaatcatggaggtagaggaagcaaaaaacacacataacaaagaatgtggactttggagtcaaactaatgtgagtccaaacccaggctctctcccaaaccagtttgggcagatggcccagtggaacctcactctcctcatcagtaaaaagggggcagagtgagggtcctgagagctagtacagggactgtgtgaagtagacaatgcccagtgtttagcgtaagaatcagggtccagctggtgctccctaaacagcagctgctgttcactgttgaaaggcgctctggaaggccaggcgcggtggctcatgcttgtaatcccagcactgtgggaggccgaggtgggcggatcacctgaggtagggagttcgagaccagcctgaccaacgtggagaaaccccatctctcctaaaaatacaaaattagccaggcgtggtagcacatacctgtaatcccagcgactcgggaggctgaggcaagagaattgcttgaaaccagcaggggaggttgtggtgagccaagatcgagccattgcactccagcctgggcaacaagagcaaaatggcgaaactccatctccgagaaaaaaaaaaaaaagaatactttctgaaagtatttattcatacaaataaagacttgacccataaggtaggaacgcaaatgggccacggaatcactcattccacagtatacaccgagtgcccttgaagtgctgggcactgctccaggattgggggcatattggtgaaagagaagcaagctgcctgctcagatggcagggaatggggaaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggttggctttaatctccaccagactcttgccccgggactgtgatgggcgattggccacttctcctcgataacattactgtttttcttccgccttctggttgactttagccagaaccagtgcttctataactccagttacctgaatgtccagcgggagaatgggaccgtctccagatacggtgagggccagccctcaggcaggagggttcaccgtgggaacagggcaggccagcataaggtgggggctggatgtagagccctggaggctttgggcacagagaaataaccactaacatttttgagctcttaccacgtgctcagaaaaaatccctaagaagacactgagagaattagatgaggaaacataagaacagagacctcaaatagtttccccaaggtcacacagcttataattagaactagaattggaactccaggctggcttcagatctgcctctctctcacgccctctttaagatcctttgcaaaccaatggtagaagcctgtatgttggagaggtggtaccttcaactatgtcccccatcaccgcagaggtggcacatggcagggatctgatggagctgaactgacatcatttagcatcccgagcctcctctctgggcctcattttcctcctctgtaaaacggggagaaaggccctgacagccacagtctgtgtgaggctcctgagatctcatgtacagaaagtgcttggcgtggagctgggcacgcagcaggggctgggcacacggtggcccaaaggagacccgggccttcactgatgggctttgtggccccggacacacctaggactcctcacctgtaagacaggcaccattgtgccatcccatgttctcacccagaggctctttttctcttccagagggaggccgagaacatgttgctcacctgctgttccttagggacaccaagaccttgatgtttggttcctacctggacgatgagaagaactgggggctgtctttctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgtgcattcccaggtcagatgtcatgtacaccgactggaaaaaggtaaacgcaagggattggacagtgcccaccttgtccatggcccaacttgggcagccccagaggcccagagcaggaaagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccgctcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagtttaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggatgtgttcttagggtgctcacctgggagacccagaagaaggagataacacgtaagggtgaggctggtccctggaaatcagctgacatcctgcaaatgtggagccctgaggtggagccaagcccgaggcacagcccactcagtggcacaagccacaaagggccggcctcaccccaacctgggtgctcgtgattgacagcctcttgttacgtgagggaagcagcaccccttccgtggcagaaaagttgggcctgaattgtttgagcaattccacgtgtgcagctgcgtataccatccagggtgataggaccatgagcccgaggccctgatgtcctggggtctagtcctgtgtccacaggcaccactcccctttgtacctcctgtcccaacagccaagctccacagggccaagactacagcatcctttgctcagcacccaaaccacagctgtgcccacagcacggaggctggggacaccgagctgatgtcctcagaaggcaagtggacaggacagcctctggggtcccacaatgtcctggaactgaaggctcagaacctacaggaagtttgtccatttcagtgttactttcagtgagacaccattttcaaccatactcaggaggatccgctgaaaaatgaaacagaaatgagtcatgatgggcagagcagggagaagcaagggagacgagaagtggggaacatggaagaaaaagccacgtgaggaagaaaccagaggtcaagagaaaaagaatcatggaggtagaggaagcaaaaaacacacataacaaagaatgtggactttgggtcagaccaatgtgagtttaaatccaggttctctcccaaaccagtttgggcagatggcccattggaaccccactctcctcatcagtaaaaggggggcagagtgagggtcctgagggttagcacatggactgtgtgaagcagacaatgcccagtgcttagcaccggaatcagggtctagcaggtgctccctaaatggcaggtgctgtttgctactgaaagtactggaaggctgggcgccatggctcacgcctgtaatcccagcaatttgggaggctgaggtgggtggatcacctgaggctgggagtgcaagatcagcccgaccaacatggagaaaccctgtctctactaaaaatacaaaattagccagacgtggtggtgcatgcctgtaatcccagctactcgggaggctgaggcaagagaatcacttgaacccgggaggcggaggttgcagtgagccgagattccaccactgtaccccagcctgggcaaccagagcaaaactcagtctcaaaaaaaaaaaaaaaaagaaaaagaaaaaagaaaaaaaaaagaaagaaaggagcactggagagtccaggtgcatactcttgtagacagcaacttgctgtgtgcctcatttacatctctggcctcagtcaaaagggacttggctaggcagccccacctcaaggccctccgcagttgaaagatttatggttctgagataggcaaagg

SEQ ID NO: 21 - DNA, 6032 bp, Homo sapiens
caggctgcgcctgggatctctacactcgagcagacggagaccccagaccccattggcctaagtgcctgaacgttataaatcaaaagtattttaaatgaagctgacatgtttacatttaagttttagaaatttaattaattatcccagcactttgggaggctgaggcgggtggatcacaaggtcaggagatcgagaccatcctggctaacccggtgaaaccctgtctctactaaaaaaatacaaaaaaatattagccgggcatggtggcgggcgcctgtattcccagctactcaggaggctgaggcaggagaatggcgtgaacccaggaggtggagcttgcagtgagctgagattgtgccactgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattagccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcagtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaaggacagaggtgcttatctgttatttaataaactgttgtgtgtgggtgggtgtgtgggtgggtgtgatatgtggggctctctaaatccctgggccccaatagtccaggtctaatggtggtgctgtccccaacaatgctcagcttctcctcaaaatacatggtatctgggctgggcacggtggcttacacctgaaatcccagcactttggaaggccgaggcgggtggatcacttgaggtcaggagttcaagatcagcctggccaacatggcgaaaccctgtccgtaccaaaaatacaaaagaaattagccaggtgtggtagtgacacctgtaatcccagctactagggaggctggataggagaattgctggaactcgggaggcggaggctgcagtgaactgagatcgtgccactgcactccagcctgggcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtccccatcatctcacccctggaccactgcatcagctccagctggtttctcaggtttaatctccttccctagccctccccattcttcccattcagacagagcgatctttctgaagaaccaatctggttatgcctttccaacccctttgaaatctttccatttctctcctacacctcctaagtctagcgaacccctcagcctggcttccatgccctgcaggctccatctcctgccaacctcttcaacataaagtctggccactcccacttatcatgtgctccagctgcacagactttccagctccctgatacacccactctctcacctgcgctcttccctcttgataactccaatcattgtttcaagcctcaaattagagcaatgcaaattcaagaaacaaaccaagctggcaaaaacacaaaaaagaaaggaaaaaaaaagggtcatttctgttctgacaaggatggggataaggagactcacttgtacactgccaaactgacattcaaaatccttagtgcttttggatttgtcatgtttgggaggagggtttttaaatcatcggctttcttgaggttgaataaataaaagaaaatgcacacattttaggtttactgttcaattagtttttacaactatacgtgtgtgtgtataatggccaccacgatgacaacctggatcgttgtcatccacttcagtgttctctcatatgcttttgcagtcaaattgccctcttttgcccttggcaaccactgatctgatttctaaaattatagatttgtttgagctgttctagaacagaaccgtacagtatataagctcctttgtatctggcttcttttgttcagcatagtgtttttgagattcatccatggtgttatatgtatcaatagtttaactatttttattgttaagtaatattcctttgtaagaaaatgccacatttttatttaccattttcctgttgatgggcatttggattgtttctttctttttttttggtttttgtttttgcttttgtttttgttttttagacagtcttgctctgtcaccaggctggagtgcagtggcacgatctcggctaactgcaagctccacctcccaggtttgagcgattctcctgcctcagcctcctgagtagctggtactacaggcgcatgccaccacactcagctaatttttgtatttttagtagagacggagtttctccatgttggccaggcttgtctcgatctcttgaccttgtgatccgcccacctcggcctcccaaagtgctgggattacaggcgtgagccgtggtgccccacccttggattatttctaattttggctattttgagcaatgctgttatgaacattaatatgtaagactttgtgcatagcacgtggtttcctttcccttggatactaaggtaattttaaaagggaaattggctgctctctgacacttatcatcagaggaaaaatcacaatatgaaatgctgttagataggctgggagtggtggctcacgcctataatccagcactttgggaggctgaggcaggaggatcacttgaggccagaagttcaagaccagtctgggcaacatagtgagactctgtctctacaattttttgttttttaaatttaattagccaagtgtggtggtgcatgcctgtagtcctagctactccagaggctgaggtgggaggattgcttgagcccaggagtttgaggctgcagttgagctatgattcataccactgcactccaacttgaagagcctgaaaaaaaaaaaaaagtgctgtagacataaaggacatgactaagtaggttagaatatagtaagcgggccaggcgccgtggctcatgcctgtaatcccagtactctgggaggccgaggtgggcagattgcttaagctcaggagttcgagaccaacctgggcaacatgatgagacccccatctctacaaaagtacaaaaagttagccaggtgtggtggcacgcacctgtggtcctagctactcgggaggctgagctgggaggatctcttgagcctgggtggcagaggttgcagtgagccaagatcccaccactacactccagcctgggcgacagagtgagatgccatttcagaacaaaaacaaaaacaaaaaaagaatagagtaagtgaatgaaaagttgtgcatccattacacttttatttatttatttatttatttatttttgagacagggtctcttgctccatcatacaggctggagtgtagtggcaaaatcacagcttactgcagctttgaactcctgggctcaagcaatcttccagcctcagagtccagagtagctaggctttcaggtacatggcaccagacctggctaatttttttgtttgtttgtttgttttccttgagacggagtctcactctgtcacccaggctggagtgcagtggcgccatctcagctcactgcaagctctgcctcccaggttcacgccattctcccatctcagcctcccaagtagctgggactacaggcgcctgccaccacgcccagctaattttgtttttgtatttttagtagagatggggtttcaccatgttagccaggatggtctccatctcttgacctcatgatccgcccgcctcagcctcccaaagtgctgggattacaggcgtgagccaccgcgcctggccgacctggctaatttttaaatatttttgtgtaaagatagggtctcactatgttgcccaggctagtcttgaactccaggactcaggtgactctcccatcttgggtccattaagcttttaactacaaactacactgaaatatgaaagttattcagaatgaaatgaataagaatgcaaaattataatcataccgtaagaatactttctgagtaatcccagcactttgggaggccgagacgggtgagtcacctgaggtcgggagttccagaccagcctggccaacatggagaaaccccatctctactgaaaataacaacaacaaaaaaaattagctgggcgttgtggagggcaccagtaatcccagcgactcaggaggctgaggcaggagaatcgcttgaacccaggaggcacaggttgcagtgagccgagattgagccattgcactccagcctgggggacgggagtgaaactccgtatcaaaaaaaaaaaaaaatgaatactttctgaaagtatttattcatacaaataaagacttgacccgtgaggtaggaacacaaatgggccacggaatcactcattccacagaatataccgagtgcccttgaagtgctgggcactgctccaggattgggggcgtattggtgaaagagaagcaagctgcctgctcagatggcagggaatgggggaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacacagctgttgccacactcagtggaactgaatctatgtttgtcttccccggcatccttcaccccaactctccccgccacaacatacatcccatgccagcctggggaccctcaaaggtggcttcatcattaggtttgtggctgggtcccactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagt

SEQ ID NO: 22 - DNA, 1943 bp, Homo sapiens
ctgcgtacaccatacagggtgataagaccatgagcctgaggctctgacaccccagggtccagtcctgtgtcctcaggcaccactcccctttgtacctcctgtcccaacagccaagctccacagggccaagactacagcatcctttgctcagcacccaaaccactgctgtgcccacagcacggaggctggggacaccgagctgatgtcctcagaaggcaagtggacaggacagcctctggggtcccacagtggcctggaactgaaggctcagaacctaaaagaagtttccccatttcaatgttactttcagtaagacaccattttcaaccatactgaggaggatccgctgaaaaatgaaacagaaatgagtcgtgatgggcagggcagggagaagcaagggagacgagaagtggggaacatggaaggaaaagccacgtgaggaagaaaccagaggtcaagagaaaaagaatcatggaggtagaggaagcaaaaaacacacataacaaagaatgtggactttggagtcaaactaatgtgagtccaaacccaggctctctcccaaaccagtttgggcagatggcccagtggaacctcactctcctcatcagtaaaaagggggcagagtgagggtcctgagagctagtacagggactgtgtgaagtagacaatgcccagtgtttagcgtaagaatcagggtccagctggtgctccctaaacagcagctgctgttcactgttgaaaggcgctctggaaggccaggcgcggtggctcatgcttgtaatcccagcactgtgggaggccgaggtgggcggatcacctgaggtagggagttcgagaccagcctgaccaacgtggagaaaccccatctctcctaaaaatacaaaattagccaggcgtggtagcacatacctgtaatcccagcgactcgggaggctgaggcaagagaattgcttgaaaccagcaggggaggttgtggtgagccaagatcgagccattgcactccagcctgggcaacaagagcaaaatggcgaaactccatctccgagaaaaaaaaaaaaaagaatactttctgaaagtatttattcatacaaataaagacttgacccataaggtaggaacgcaaatgggccacggaatcactcattccacagtatacaccgagtgcccttgaagtgctgggcactgctccaggattgggggcatattggtgaaagagaagcaagctgcctgctcagatggcagggaatggggaaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagt

SEQ ID NO: 23 - DNA, 123778 bp, Homo sapiens
gagtctgggtagtttataaagaaaacaggtttaattggttcacgattctgcaggctatacaggaagcatgactggggaggtctcaggaaacttacaatcatggtgcgaaggcacatcttatattgaccagagaaggaggagggagagagagaagagggagctgctacacacttttaaacaaccagatctcatgagaattcactcactatcatgagaacagcaagggataagtctgaccccatgacacccaatcacctcccaccagacccctcctccaacattgaggattacaatttgacatgagatttgggtggggtcacaaatccaaaccacatcaatacccatataataatttgttttatttatttttttgagacacactctcactctgttgcctaggctagagtgcagtggcacaatcatagctcactgtaacctcaaactcccaggctcaagcgatcctcctgccttagtctctggagtagctgaggatacaggtatgcatcagcacacctagctaattttatttttttatttttatttttgtagagactgtgtgtctatgtttccgaggctggtctcgaattcctggcttgaagtgatcctctggcattggactctcaaagtgctgggattataggggtgagccactgcaccaagcccagacctctcctattagaggctttctctgatttaggaatcagacatgactgcttcctcctctgggcaacttctttcccccctcccatggttctattattgtctttcctcctctccagcaccgtgttggtttccacacatgagcagtggtgatcccttaccagagcatgagcttcttaaggacagtctgagtattattcaccactatgtctgcaggccctagctgagtcctttacacagagtgggcatccagaaagatttgttgagtttagttgggttagattgctgcatattgcaaaacttttcctgggactctttccctaggactctggtgaccaagccactttcctgcatacagcaagagcttttggctgggcctcagctgccattcctgtacattcagaatgatccaccaggattctgttgtcaagagggcctgtaatggagacacagggaaggagatgaagatgacggcttcagtgagaagcagcatactgtgctgcttcctgtgcaccccctcaaatggttctgcagaagacggaaagctagagatgctcctgaccaaagaatgcccctctctctggaaataatgcatgtctgggaacaatgggtgtgaaaggagagaagaggagaacagctacctggattgccaggtggactccagccaccttagccaccagggatgtggctgatgtcactacaagcagcacatacaacatcaaggactccaataagatgatttgagcttcttctttggggtagtaggggtcagaacagacacatcctgctttctgaagagtgaaatatttaccccaggagctggtaaggatgaggcctgcgacagcaatgctgtcatctgagagcccctctatgcctgcttgctggaagagatcccaaagctgagcctttggaaatggcactggctcattatcatcactgacccacgttccatgtctccttgccctgaggaattatgaattatgtgacaagtaaatcctcgacattcttaaaagtcagcagaaatacagccctaaactcctgggctcaagtgatcctcctgccctagcctctcgagtagctggaactacaggcatgcatcaacatgtccagactttatttgttgttgtagatatggggtcttgctataatgcctaggctggtctcaaagtgcgggctcaagcaatccttctctctcagcctcccaaattactgggaatacagacatcaaccactgagcctgatcttgatagaaattcttagtaaaaaggatgacttttaaatattaaatctagattctcaagcagtatggtaaactatttttgaaaagccatatacaattaaatttgtatatgttaaaacttgcaaaataatcttgagtaggctggacgtggttgcttatgcctgtaatgccagcactttgggaggccaagaccagcggatcacaaggtcaggagatcgagaccatcctggctaacacagtgaaaccccgtctctactaaaaatacaaaaaattagccgggcatggcggcgtgtgcctgtagtcccagctacttgggaggctgaggcaggaggatggcgtgaacctgggaggcggagcttgcagtgagccgagatcttgccactgcactccagcctgggcgacagagcaagactctgtctaaaaaaaaaaaaaaatcttgagtagatattatacattttaattatacaagcagccattgacttctgaaaagtccagtaacccctcctaattaaacccatcctatgaaatgatgggaagagggcttcaggagactttatttatttatttatttattgaaacagagtcttgctctgtgggccctgagctggagtgcagtgaagtgatctcggctcatcgcaacctccgcctcctgagttgaagcacttctcctgcctcagcctcccccgtagctgggattacaggtgggcactactgagcccagctaatttttgtatttttagtagagacggagtttcaccatgttggccaggctggtcttgaactcctggcctcagtgatcagcctgcctcggcctcccaaagtgctgggattacaggcatgagccaccgcgcctggcctgtgcttttgcttttaacatctcatcttggctacaaagagcagtgcaaatggggaacttctcaagtcctacagcattttgaccatagttttagcctcactcttatcaagtcagcaacactgtaacttccaatctcagttgagtggagggcaagcaaattgctatagagactgagaaacatcagcctgtagatgcctgggagctgggctagggactatcttccccttcccaaatgtgccacaagcctgctttctcccgcactgagccccctatttgtacagatgcacagattggctacaaagcttccattaagccacaaataggatgaaaaccatctctaccctcctccattcccatgcagaaatcctgcttcagagaaggagttgcatattgaatgcatgaatcctagaaataagacttagaaggtcttgtttgacatcaatcaatgacaactgtctttaagttcatcagggaaaagatcccaacttttctataaaggtaacaccatgttatttttaattttaaagtgacatgaatgtatttttctaagagacagacaaacacacccacaaacacccacacatacataaatgtcagattaaaattaaaaattaaataccttaaaatttgtggccaggaaccccaattcaactgcaaatcactccttgaacatttactgaatgcttgccatggaaatgtcccctgcaaagtgctatttgaattttatgaaagaaataaaatgaagtgatattttttaaggggctgaggacagacattcttagatatagagagaacttagtaaacaaacatgaatgatttagtgacaaatatgaaatcaggtgatgataacagcctgcagtaatgaataacaaagcagaggactgaatgggccctggactagatggaagggcttttcggaggaggttggggattgaaccaggacatgaaggatggggagaggataagaaagagagagggaagaacattcatagaattattgttgggttgagaactagcttggcttgtcagcaggaagggtcctggaaggtgagttctaacagtcaggatgaccctgacctctgggagattttctactctggaagaaatgtcttgatttagtgattctcaaatttggtttcacatgagaagcaatggagaggatgtttaaagcaacactgtggggaaagtattttagaatctctgagatgacacaagcatcgtgaatatttaaaactcccaggtgatcacaatgaacagctagtggttgagaaccactgtcataagaaatcttctggaaattcttttttaaatttttatttatttaaatttaaaatttttatttttggtgggtgtgagaaaacattttaaatgatccattttcttttttttttttttaatgtttttttttttaattatactttaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtggtctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtacatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtattgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgacttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggactgacttggcgatgtgggctcttttttggttccatatgaactttaaagtagttttttccaactctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaaggggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattcccttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactccttttttgttggtaaactattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttaaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtcccgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctatggtgggctccacccagttcgagcttcccggctgctttgtttacctaagcaagcctgggcaatggcgggcgcccctctcccagcctcgttgccgccttgcagtttgatctcagactgctgtgctagcaatcatcgagattccgtgggtgtaggaccctctgagccaggtgtgggatatagtctcgtggtgcgccgtattttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgctcacactggcctgcgcccactgtctggcactccctagtgagatgaacccggtacctcagatggaaatgcagaaatcacctgtcttctgcgtcgctcacgctgggagctgtagaccggagctgttcctattcggccatcttggctcctcccccttaaatgatccattttcaaggcatggtaaatctaagcactggcagccagcctgtggatgtaacaaactgcacggctcatgcacctagaaggtcataataagtgaacagaatgtagaggaggggtcagcccataaaagggaagaaagttttattatcaggaagtcaaacttaagcagggaagggaaccggggtataaccttataagggggataatgaaacttaggcgatgtccaggaagataactctgtagtacttgaccaatgaggaactgggggaaggaattctgtgctaggagataaattacctgctgtaactgccctggttgtacctgcctaccagacacccgatcttgcaaggccaccattaaaagtcttgcttccggccaggtgcagtagctcacacctctaattccagcactttgggaggccaaggccaggagtttgagaccagcctggccaatatggtgaaacactatctgtactaaaaatacaaaaaatacaaaaatacatggacattgtccatggcaagcattcagtaaatagtcaaggagtgatttgcagttgaattggggttctaggccacaaatttccaagcatggtggtgcacacctatagtcccagctacttagaaagctgaggcaggagaatcgttttaacccgggaggcagaggttgcagtgagctgagatcacaccattacactccagcctgagcaacagagcgagattttgtctcaaaaaaaaaaaaaagtctcacttccactgttcttcatgtctccaagttcattctttgggtttggacaggtgaatgtgtttaccacaaacttgtggacccacctggggcttctgtgcctgtgtggagtgggactcttgctgagaggggagacacatctcacctgatttagatagcccgctctgtttaggtatcccgacttcccgcagaggccatagacaaacctgagactgttattcaggaggcagaggaggtgacacaggaggaaagaaggcaccacagcaaccaggcaaccttgtgtatgagccgaggaagaaaaattggaccataagtactaccttggtggttgggcatttttggaggtcaagtgtgtgtgactgagatgtatcctagatatgaagtgagtgcggagtcccaatctgcagttctgttctcccacgagggaaatggccatagatggatgaagcgattctcagggtgtgcaggaaacctccagtgaggctggggggtggttgagtacacagggaaaaagctcagacacagagactgactgaagatgagaaacagaaattctaggcctaaggcacaaaggaaagagggagccaaaaagattccctctgacattcccccggacagtcctttagggataatgctgcaggtttggagggacaaccctcaagccagggacaaagaaaagaaaagatggtaagtactgctgttttatctgtcctaaagaccccattcataagccttcagtcttttgacctaggtttggcccagatgaggattgggtgtgccaagctttatttttctatgtgaatgataaaaccccatcctcacaagagataagttatgctgtctgctggatcaaggaattagccctcatattcccccttcaaagaaaaagaaaaagaacctagtaaaaaatccttgcccagtgaaaagccatgggaccccctatcatgcttgccccctccatacctctcgcaaaataggggacaggaagatcaaggggcagcaggaggattagcggaagaaagacctggagaccatgggggagccgaacaaattgctcctttaaaaccttatccaaattcaagcaaagtattagaacagtgaagtagactgagtacaagtcccttagcagcattacaaaaggtccaaaagcctatagtcctggaacaggaattaaaagaaattaaagagtgtgtaaagcagaaactcagttgtatataagaaaacccaactccccctgagaaagagaaagagctggagtcctttaaaattaactgcctgtttttctgtggctagtaagccttatctcttctcccttcccaggttttgtgaagactctgtttctcttgccatgcagctgccagatcactagacagataaactcaagtcacaaaacatatttttccttaaagagtaagaaatgatgtaatgcatgtctcaattaaataactgtctttgtttctctcttctgtagtatgcttccccctgtacagatctcccccgacccatgaaatacttaaaagataaccctttgttcaaggctcagtcctttggatattaatctgactgggctttctatcagacttgtctttctttttaaggctgaataaccttccattttgtgtatacatcacatttcgtttacccattcatatgtcaatggacacttaggctgtgtctaccttttggatattgtgaataatgctgctatgaacatggcttaaaaatatctttttggagtccagtttcagttattttcggtatatatccagaaataatatcactggatcatacagtaattgtattcttaattttctgaggaaccaccacacttttccatagtagctgcaccattttacattcccaaatagaagctacagatgttccagttcttccatatcttcaccaacatttgctattttttagttgttttttttatagtagctatcctaatgggtgtgaggaaatatctcatcatggttttgattagcattccctaatgatttgtgatattgagcattttttcatgtgctttttgctatttgtatatcttcattggagaaatctctattgaagtcctttgcctattttttaagtcaggttatttgtttttgttgttgctgaattacaggaattctttatatattctggatattaaccttttttcagatacttaaattgcaaatattttcttacattctataaattgctttttcacttcgttgattgtgtcctctgtcacacagagtttaatttcaatgtagtccacattatctatattttcttttgtcgcttgttcttttggtgtcatattcaagaactcattgccatatccaatgtcataaatcttttcctttatgtttctttctaagagtttttatagctttagctcttttacttaggtctttgatccatttcagtgaatttttatgtatggtgtaagctaacggccaagtttcattcttttgcatgtagatatcaattttcccaatactatttgttgaaaagactgtctgtccattccctattggtcttggcacccttgtcaaaaatcatttgaccatgtatacaaagttgatttctgagctctctgttttgatccattgatctctatgtctgtctttatgccagcaccatactgttttgattactgtagctttgtagtaagttttgaagtcagaaaatgtaagacctccagctttgtaattttttcaagattattttggctatttggggtcccttgagattttgcatgaatttttttgtttctaacaaaaaaacccaccgtttggatttggacagaaattgcattaaatttacagatctctttgggtagtattgacattgtaagtatattaagtcttccaattcataaacatgaaatgcctttccatttattggcgtctttaatttctttaagcaatgttttgtagttttcaatgtatgtttctttccttcttggttaagtttattcctaagtattttattctttttgatgctattgtaaatggatttttttcttaattttcttttcagacggctcatagttagtgtatagaaacacaactgatttttgtgtgttgattttgcatcctgcaactttgctaaatttgtcttgaactcctgatctcaagcgatcctcccagctcagcctcccaaagtgcctgggattataggcatgagccaccatgcccaactatgccaaatttgtttattagttctagcagcttttcttgtggaatcttcagtggttgctacatataaaatcatgccatttgtgaacagggataattttacttcttccattctaacttggatgccttttatttatgtttcttagttaatcgatctggctagtgcttccagtattatgttgaatagaagtggtaaagtagatatccttgtcttgtgcctgatcaagcagaaaaagttttcagtctttcataaatggaaatgaagacatatgtggcctttattatgttgaggtattttccttctattcttaatttattgagtgtttttatcatggaatggtgttaaattttgtcaaatactttttctgcatcaatttagatcatcaatcacgtagtcttttttttcctcttcattctgttaatatggtgtacattggttgattgacatctgctgaatcacccttgcattctaggaataaatctcatttggttatggtttataatccttttaatatgctgttgaattctatttgctagtattttgatgaggatttttgcaccaatattcatcagatattttggcctatagttttcttgtagtgtctttatttttctttggtatcaaggtaacactgcctcatagaatgagtttggaaatgctccctccctttcaattttttggaagaattcgaagacaatttgtttttgacaatgatccctttaatgtttggtagaattcaccagtgaatccatgtgtcctggactttttattatgggggggttttgatcagtgattcaacctccttaacagtcacagatctgttaagattatttatttattctgattcaaacttggtaggatgtgtttttataggaatttgtccatttaatcaaggttaaccaatgcattgttgtacaattgttcatagtactatcttattatttttatttttgtaaatttgatagtcatattctttcttttctaatttccattatttgtgtatttttttcttactgtatctaactaaaagtttgaccattttgttgatcttttaatgaaccaactcttggtttcattgattttctctattgcttttgtattcctgattttgtttttctttgctctaatctttattattaccttacttttgctagctctgggtttagtatatttttcttttccagtttcttaatgtataaggtcagattgtagatttgagatctttcttctttctattttttttctgtgataacagattaatttaaattctagacctgaagctctacaagggtatgctctttaaacattctataaatgtgtacaactgtgcaataccacttaaaatctcagaaaacgaacacactttagaattgtttaaacacaatccacagaattaaaaacaaaaccagaagccattcacagttatactattgtcaattaaaagttttatacttaatacttgatataacagtcaatatctagtgggggatattgaaagtgatttcagggggcagagccaagatggccaaataggaacagctccagtctacagctcccagtgtgagtgacgcagaagacgaatcatttctgcatttccaactgaggtatcgggttcatctcactggggattgttggacagtgggcacaggacagtgggtgcagcacactgagcatgagctgaagcagggtgaggcatcatctcacctgggaagtgcaaggggtcagggaattccctttcctagccaaggaaaggggtgacagacggcacctggaaaattgggtcactccctccctaatactgggcttttccaatggtcttagcaaatggcacaccaggagattatatcctgcgcatggctcagaggttcctatgcccatggagcctcactcattgctagcacagcagtctgagatcaaactgcaaggaggcagtgaggctgggggaggggcgcccaccattgccgaggcttgagtaggtaaacgaagcagctgggaagctcgaactgggtggagcccaccacagctcaaggaggcctgcctgcctcagtagactacacctctgggggcagggcatagccaaacaaaaggcagcagaaacttctgcagacttaaatgtccctgtctgacaactttgaagagagtagtggctctcccagcatgcagcttgagatctgagaacagacagactgcctcctcaagtgggtccctgacccccgagcagcctaactgggaggggcagactgacacctcacacggccaggtactcctctgagacaaaacttccagaagaatgatcaggcagcaacatttgctgttcaccaatatccactgttctgcagcctctgctgctgacacctaagcaaacagtgtctggagtggacctccagcaaattccaacagacctgcagctaagggtcctgactgttagaaggaaaactaacaaacagaaaggacatccacaccaaaaccccatctgtacatcaccaccatcaaagaccaaaggtagataaagccacaaagatggggaaaaaacagagcagaaaaactgaaaattctaaaaatcagagcacctctcctcctccaaaggaacacagctcctaaccagcaacggaacaaagctggacagagagtgactttgatgagttgagagaagaaggcttcagacgatcaaactactccaagctaaaggaggaagtttgaacccatggcaaagaagttaaaaaccttgaaaaaagattagacgaatggcttactagaataaacaatgcagagaagtccttaaaggacctgatggagctgaaaaccatggcacgagaactatgtgacaaatgcaaaagcctcagtagccgaagcaaacaactggaagaaagggtatcagtgatggaagatgaaatgaatgaaatgaagcgagaagagaagcttagagaaaaaagaataaaaagaaatgaacaaacctccaagaaatatgggactatgtgaaaagaccaaatctatgtctgactggtgtacctgaaagtgacggggagaatggaaccgagttggaaaacactctgcaggatattatccaggagaacttccccaatctagcaaggcaggccaacattcaaattcaggaaatacagagaacaccacaaagataatcttcgagaagagcaactccaagacacataattgtcagattcaccaaagttgaaatgaaggaaaaaatgttaagggcagccagagagaaaagtcgggttacccacaaagggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaatgagctcctgaaggaagcactaaatatggaaaggaacaaccagtactagccactgcaaaaacatgccaaattgtaaagaccatcgaggctaggaagaaactgcatcaactaacgagcaaaataaccagctaacatcataatgacaggatcaaattcacacataacaatattaaccttaaatgtaaatgggctaaatgctccaattaaaagacactgactggcaaattggataaagagtcaagactcatcaatgtgctatattcaggaaacccatttcacgtgcagagacacacataggctcaaaataaagggatggaggaagatctaccaagcaaatggaaaaccaaaaaaggcaggggttgcaatcctagtctctggtaaaacagattttaaaccaacaaagctcaaaagagacaaagaaggccatttcattatggtaaagggatcaattcaacaagaagagtgaactatcttaaatatatatgcacccaatacaggagcacccagattcataaagcaagtctttagagacctacaaagagagttagactcccacacaataataatgggagactttaacaccccactgtcaacattagacagtcaacgagacagaaagtcaacaaggatatccgggaattgaactcagctctgcaccaagtggacgtaatagacatctacagaactctccaccccaaatcaacagaatatacattcttttcagcaccacaccacacctattccaaaattgaccacatagttggaagtaaaacactcctcagcaaatgtaaaagaacagaaattataagaaactgtctctcagatcacaatgcaatcaaactagaactcaggattaagaaattcactcaaaaccgctcaactacatggaaactgaacaacctgctcctgaatgactattgggtacataatgaaatgaaggcatgttctttgaaaccaacgagaacaaagacacaacataccagaatctctgggacacattcaaagcagtgtgcagagggaaatttatagtactaaatgcccacaagagaaagcaggaaagatctataattgaccccctaacatcacaattaaaagaactagagaagcaagagcaaacacattcaaaagctagcagaaggcaagaaataactaagatcagagcagaactgaaggaaacagagacacaaaaaacccttcaaaaaatcaatgaatccaggagctggttttttgaaaagatcaacagaattgattgactgctagcgagactaataaagaagaaaagagagaagaatcaaatagatacaataaaaaatgataaaggggatatcaccaccaatcccacagaaatacaaactaccatcagagaatactataaacacctctatgcaaataaactagaaaatctggaagaagtggataaattcctggacacagacaccctcccaagactaaaccaggaagaagttgaatctctgaatagacccataacaggctctgaaattgaggcaataattaatagcttaccaaccaaaaaaagcccaggaccagatggattcacagctgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttaaaccaatatccctgatgaacactgatgcaaaaatcctcaataaaatactggcaaaccaaatccagcagcacatcaaaaacttatccaccatgatcaagtgggcttcatccctgggatgcaaggctggttcaacacatgccaatcaataaacataatccagcatataaacagaaccaaagacaaaaaccacatgattatctcaatagatgtagaaaagacctttgacaaaattcaacagcccttcatgctaaaaattctcaataaattagatattgatgggacgtatctcaaaataataagagctatctatgacaaacccactttttgatggggttgtttgtttttttcttgtaaatctgttttagttctttgtagattctggatattagccctttgtcagatgggtagattgcaaaaattttcttccattctataggaagtggggtgattacaagggtccagggcagtgggtgagggtgggggtgctcctctatgtctctctgcagcacagctatacatatggccatctgggagcactgttttcttaagttttagcttaggttcaggggtacatgaacctaaggtttgttacataggtaattatataacaggtttgttatataggtaaattacatgtcccaggggtttgttgtgcagataattttgtcaccgggacaacaaacctagcacaggataggcagttttttttacccttaccctcctcctaccttctgcccccacataggccccagtgtctgttgttttcttctttgtgtccatgtgtacttgatgtttagctatcactcataagtgagaacatgccgtatttggttttctgttcctgtgttaattaacttagaataatggcctccagctctgctcttgtccctgcaaaggacatgatcatattatttttaatggctgcttagtattccatggtgtatgtgtgccacatttttttttttacccagtctatcattgatgggcatttaggttgattccacgtctttgttattgtaagtaaagccactgtggaaagcagtttggcaatttctgaaataacttaaaatataattgctatttgactcagcattattgacccactattgacccattattgagtatttacccaaaggaatgtaaatattctaccataaagacacatgcacacatatgttcattggggcactttttttttaatggaaatgtttataactacaagtttcccttttagcattgttttgctgcatctcatcagttggtatttttttgttttcataataacgaaacaaaaaatatcttgtcttgagatattttctaatttctcttgtgatttattctttgacccattggttgtctaagagtatgttttttaattttcatgtatttgtgaattttccagttttcctcctgctattgatgtctagttttatttaattgtgattggaaaagatacattacatgatttcaatctttttaaatttattaagacttgttttgtggcctaatacatgatatatcctgaacaatgttctatatgcacttgagaaaaatgtcttctactactgttgggtggaatgttctatatatgtctgttgggtctaattggcctatagtgttgttcttgtcccttatttccttattatcctctgtttagttgttctatttaatatcgaaagttgactgttgaagcctcttactattattgtagagctatttattttctcatttaattctatcaatgtttgtgtcatatacttaggagctctgatgtttagtacatatatgtttataattattatatctttttggttaattcactcttttatcattatgtaatgttctttgtttcttgtaacagtttttgaactaaagtcaatcttgtatgacactagtgttagtatagctactccttctatcttctgattattatttgcagggaatgtctttttctattctttcactttcaatgtatgcatgtttttagatctaaagtgagtcacttgtagacagaatatagttggatcctatttgttttattcactctggcaatctatgtctttatattgaggggtctaatgtatttacatttaaaacatactgatggggaaggacttactactgtgattttgttatttgtcttctgcatatcttacagcttttttgtccctcattttcttattgcctttctttgtatttggttgatattttatagtgacatgttttgattaccttctcattttctattgtgtattctgtatatattttctttgtggttaccatggtgattacataaaacttcctaaggttataacaatgtattttaaattgattacaatttaacttcagtttcattaaaaaccactactcctttacagctctgcactccctcctttatgttatttatgtcacaaattacatctttttatatcatgtacccatttacatagacatagttatttgttatgctttggtcttttatatcctataaaataattaaaagaggagctacaagcctaagttgcaataacacaggttttagatttgtacatatatttacttttaccaaataactttatattttcatattttcatatggtttctagtcactttctagcaataaataaataaataaatcaaggagaatccatctctaccagcctgtcacagcactaaaagaataccacgcagtccctgcctctttcctaaaatttttttttaaattttggcttttgttgttataactttaccaaaattatttaaagtaactttaccagcattgagttttattgactaaagtcacccggattatttcatgggtataaacccattttgtttcagccagtttgcatggggccttttctttggaaaaaataatttctgaattgctggcaagatggcggaatagaaacagctccgttctgcagctcccagtgagatcgacagagaaggcaggtgatttctgcatttccaactgaggtacctggttcatctcattgggactggttggacaagagggtgcagcccacggagggtgagccaaagcagggtggggcgtcgcctcacctgggaagcacaaggggtcgtggaattttctcccctacccaaggaaagccataagggactgagcctgaggaactgtgcactctggcccagatactgcacttttcccatggtctttgcaacccgcagaccaggagattccctccggtgcctatgccaccagggccctgggtttcaagcacaaaactgggcagccatttgggcagacaccgaactagctgcaggagtttttttttttttttttccataccccattggcacctggaacgccagtgagacagaaccgttcactcccctggaaagggggctgaaaccagggatccaagtggtctggctcggtgggccccacccccatggagcccagcaaacaaagattcacttggcttgaaattcttgctgccagcacagcagcagtctgagattgacctgggaccctcgaacttggttgggtgctgtgggggggcatcttccattgctgaggcttgagtaggtggttttaccttcgcggtgtaaacaaagctgctgggaagtttgaactgggtggagctcaccacagctcagtaaggccactgtggccagactgcctctctggatttctcctctctgggaaggatatctctgaaaaaaaggcagcagccccagtcagggacttatagatgaaacccccatctccctgggacagagcccctcggggaagaggtggcttccaccattgtggaagactgtgtggcaattcctcacggatttagaactagagataccatttgacccagcaatcccattactgggtgtatacccataggattataaatcattctactataaagacacatgcacacttatgtttattgtaacactatttacaatagcaatgacctggaaccaatccaaaagcccatcaatgatagactgaataaagaaaatgtggcacatatacactgtggaatactatgcagccataaaaaaggatgagttcatgtcctttgcagagacatggatgaagctggaaaccatcattctcagcaaactagcacaataacagaaaaccaaacactgcatgttgtcactcataagtgggagttaaacaatgagaacacatggacacagggaggggaacgtcacacactggggcatgtcggggagtgggggcctacgggagggatagcattagcagaaatacctaatgtaggtgacgggttgatgggtgcagcaaaccaccatggcacatatacacctatgtaataaaactgcacgttctgcacatgtaccccagaacttaaagtataattaataataataataatttctgggcatgtaagtagctgtctttcaggttctactttgatacatattctgagagaattaaacctgtcaaagaaaccttgactttcaatggcaggcactggaattgaccctaataatgtgttttggggtaagcctactcatattctcaacctgtctgcagtagtcgttagaatctgaacttcctgaagttcatgtgcaaagttgagttaattgtttaatattcaacaaggattatgccagtaagatggtaggaaaatattagatatgtgtcatcactgctggtattatttaaactgcaacatattttagctggctgctgatctcagccaccatgcctgcattttatctctgtctcgtggtctgcaaccttggaagctttgaacttagctcatagaatcctgggcatcaagaacatgtggttctaatggctagatagggaatgagagtaaaaggattttgcccacggtcacgtgagtaaacaacagatttggaggggtctggactactgtgatgacttcattctgacaatatgttccagttgtcctttcatttcctcctaatcacatgtctggtctgatctggctgtttcccaccttccaattcctgccttctccaatgctcccttccgtaggtcactctgtggctcagagaccctgcttagcaagcgcccaacctttcaattatttgttcagtaaaacttgaactcatgtctccccttcttgataaaaagaaaatacgttatgtaatgtcgggttactctataactcttgtcctgtctctcggcaactactgaactaactgttttcatattgagcaaacgtttatggaaggactgccaagagtcaggtactaggcttggtaatattccccgttctctctagtcaaagccaacaccagccagacttgcagatctaggtcccaagcccactgcagatcacaggccagggtctggtctcctctgagctcctttgggagggaaagacagaattattaacacccattttgtagattaggcaactgaggctgaggaagtttaaataactcagacagggcctgcacgtcagtcatattccaaggatccctactcactgtcttctctctacagaacgagatgtctctggagtccatagaaagcccaggagcctggctgggcacggtggctcctgcctgtaatcccagcactttgggaggccgaggcaggcagatcacctgagctcaggagttcaagaccagcctgggcaacatggcaaaaccccatctctactaaaaatacaaaaaattagctgggcgtggtggtgcatgcctctaatcccagctacttgggaggctgaggcacaagaattgcttgagcccaggaggcagcagttgcagtgagccgagattgtgccagtgcactccagcctgggcaacagagcaagattccatttcaaaaacaaaaacaaacacaaacaaacaaacaaaaatagaaagcccagggaccacctgcgtcaggttcccagccacacctttttcttgtcctcctctgtctctggcatcttctcacaggttcctaattgtttgtggttgcacaaattcaaaatcccagaaaaattaccacttcacacccactcagatggctattttttttttgaaggaagataacaagtgttgacaagaacatggagaaattggaattctcacccattgctggtgagaatgtaatacggtgctgctgctatggaaaacagcttggagtttcctcaaaaagttcaacagaatttcaatgtgacccagcaattcccctctaagttatagatctgagaggattaaaaacagttactaaaatacacggactcacatatttctaacagtccaattcacaagggccaaaaggtgctaatagcccacatgtccatcgatggatggataaataaattgtggtctatccatacaatggaatattattcggccataaatggaatgaagtactgacgcatgctacagaatggatgaaccgcaaaaaaaatggatgaacacatgctacagaatggatagcctcactttactatgaagtgaaggccagaaacgaaagtccatatattgcatcatacaaaatatccagaagagggaagcccacagagacagaatgtgcaatggtggatgccagggtctggggagaggggagagtggggagaaactgctcaactggtacaggctttattttggaatgatgggaacattttgcaactagatagaggtagtgattgcagaacacagaatgtactgaattccactgatttttttcaccttaaaatggttaattttcagtcctgagattggataatcataaaaaaatggttaattttatgttatgtgaatttcatccctatacatattttaaacctcagaaatatacactagcaggcatggaacaggtcactgtggtgcctgccaagcccggtgatgttatctggggtccccggccagccttaagcctcttgctgaccggtggagggcagaacctttgccctaaaagtataatatccacatgctggcatgattcctggccagatggcttctttattagcagtaattgaaactgcctcgatacagacactgtaccttgcaaccaaaaaatgactcaacaatgataataagggttaagctgggcctttctctctttgccagttaaattatatttattatagcttgacatgaaaaacaaagcaactccaacaggtatcacaagggcaaaggacatgaacattttatcaaagaagaaatgcagctgtcaaaaatacagaaatattcaaccttgttcataataaagtggctgggctcagtggttcatgcctgtaatcccagtgctttgcaaggctgagacaggaggatcatttgaagccagaagttcaagaccatcctaggcaagtcagttcaataccagacttcatgtctacaaaacatcaaaaaattagccaggcatggtgatgcatgcctgttgtcccagctactcaggaggctgaggcaggagaattgcttgagcctgggaggctgcggtggcggtgagccatgattgtgccattgtactccagcctgggcaatgcagcaagactgtctaaataacaaaaataatagtaaagaaaaggattgggatgccatttcttgcgtattcaatacacagagttaaaagtaatttctacgttttctatttttttattactaaaaaaagctggaccattctcacagcctgaaatgcttctcactttcccttcttctgtccaaacacttctctatgataatgcaaacagtcactcctttaggaagacttcaccccaggtagttccagatccccttatctctgccttcccagaactcctggtgtctctccagttccctccgtgtggtgaagtaccctacctagggtttcagtatggctctgtctgcaaaggtcttgttcacaccttcccttatggttctgttgccctgtgttgtgtcatagcacagggcacagtggagaacccattcacactgatagagagggccccatggtcctggagataaccatgtaaccgatcagaatagggcattgagggctgggtgtcaggcgtgggctgcacttgggtgggcaggtcccctggaaagtcactgggtttggcaagcttcctagtaacatgtctctctggggtccccttggaacttcatgcaaaaatgctggttgctggtttattctagagagatggttcattcctttcatttgattatcaaagaaactcatgtcccaattaaaggtcataaagcccagtttgtaaactgagatgatctcagctgaatgaacttgctgaccctctgctttcctccagcctctcggtgcccttgaaatcatgtcggttcaagcagcctcatgaggcattacaaagtttaattatttcagtgattattaaaccttgtcctgtgttgaccccaggtgaatcacaagctgaacttctgacaagaacaagctatcatattcttttcaattacagaaaaaagtaagttaattgataggattttttttgtttaaaaaaaatgttactagttttgaaaaggtaatatgtgcacatggtaaacactaagaaggtataagagcataatgcttttatactactaagaataatgttttctctaagttttttttggtagatgctttcatcagattaagaaaattccctgctattagttgttgaaggtttttatatcataaatgaaagttgaatattattatcatatattattaatatattgttattgaactatcaaagccttttcctaaaaccattgagatgatcttataaccattctcctttaacctgttgacgatatcattggtatttatactatttctctgttaaccattcttgagtctcaggtttaaattcaacttggtcatggtgtgtcatctttgatcattgctgtctgtggcttgctactgttttgtttaggatttttgcactgatgctcatcaatgagactggcatgccatcttcctttgcagtcctgatttttttctgatttggatcatgtggttatggccctcatggaatgagttgggcatgatgcctttttttcatgtctctggattgatgggacactttggattctctccagatggccctcaatggtccctgcctcctcattgttaggcccctgggcaagcccttctcatttctggtaggcccaggaacctgtgggggttttgtttgtttgtttgtttcttgagtcggagtctcactctgtcacccaggctggagttggagtgcaatggcccgatcttggctcactgcaacctccacctcccagattcaagcaattctcctgcctcagcctcctgagtagctgggattacaggcacccaccgacacaccctgctaatttttgtatttttagtacagatggggtttcacaatattggccaagctggtctcgaactcctgatctcatgatctgcccggcttggcctcccaaagtgttgagattacaagcatgagccaccacacccagtgaacctgtggtttttagaagctccccatgcatgtgaatgctgtgagcatcccaggatgacagccactgtgtgttcagctgttggaactgtgagaaagcaccagtgggaccctctccagcacctgcctgctgaggtcatggaagaggcttgttggggagatgatgccctggctgactcctgaaggatggttaggaatgcaccagatggaagctgggttggacccactctatgctgaagaacagcttgtgtggacacaaggagacacggatatgtcatttttgtagagcctgaggagtgtccagtcacaccatttgcttaaaacatcatgcacacttggaaaagtggactgagaccgaatgaagaagctaacagtggccagatcagaaagggtcttgtgttacttcctagagatacttagattttatcctgtgggtgataggagcagttggagggactgaagacaaggaaagaaacatgtttcaagatctatgtttttcaagacgctttctggtggctgagtagggaattccctggataagtcctgcccagggtcaggcaaaacaagttagggggttactgaaataaggagtatgagaaatggtgtaggttgtgctgacgttttgtaacacatctcatgatgatcttcatttccttcactaatttcctgtttcattaattcccttccacgtgctcttctgaaatttgcctcacattctctgatttctcttttacctgttggtttcatcaccttttactttttgctttcctggaaacacaaatgattctgattgtgacatgtcagaattatttgcaacatttgcctttctgctgaaaccatgagttcactgaatacacaatttagtaaagtgtaggatgcacatgtcgttttcgtggtcacaaccagctctgtagcattttataactacactggcagtgtgctgggaggtgtagagagaaatatttatcacatgtgtggctgacacaacctgccaagttattttaggagcctccttggaatcccagcaagaatgctaccggcacaatttgtaatcacagcatcctgctccatgccttggcttcatggcatagtcacttctgcaagtctctttccagctgtctgttcccatgtctataaagtatgagttaaatcatcctaacactactcatcttacaaagttttcttgctgatgttaagagagttgggaaagaactgtataaactgtgaagtgccatggagatgttagtggttactttatcaagaaatagacactctagaatggagtagaaagccaacagttatgattgagtcctcctcctcttcttctttttattaatttataaagaaaagaggtttaattgactcacagttccatatggctggggaggcctcgggaaactctcagtcatagcaggaggcaaaggggaagaaggcaccttcttcacaaggcggcaggagagagagagctcctgttcttttttgtcataaagtctacagaagtgcttatacttcaggacaagggcaggcagagagaaggaaggacattgcttcaccccagccctcactgacgagtttgctaggggacctcactttgtcccagagtaggggcagaactctggccactacccattcagaaggcctgggctgcactgctagttcctcactaactctgtgtggccttgggcaaggttgggcctgtgttaacagattatgaccctgggctctcaagctagaggatctaaatttgaatcctggctctgctaaagcaattagtgatgtaaactttaatgggtcagttaaccttcctgtggcttagtttgctcatctgtaaaatagggatcataacagtatcaataccacatgattgttggacagattgaatcagttaatgcaggggaagtacttagcatgacacgtattcactatcatttcctggagtaagagctgtgtgtgagtgggtgtgagcatgtgtgaaaccttttctctgcaatctcagttaagaaaccaatccagaatttaaagttcagggcctaaatgggtggttatcttctcccagttccatcctatcccacctttgctcttcctcccgcccacaggagctgttggtccttgattgggctggaagacctggtggaccctaagtgatctataagaggagaatagagaacagggaatgtcttcaaaaatcctagagggacacagaggctgagaggcaggcagtcctgcaggggtcttctgattgggacaaggagaaccttggtcttcacaggccaattctggtcagtttcccccatggacagatgaggaaacaggcccaggaatatccaaggtctcacacttcccatctgtcaagtcttgttgatgctgttgtattcatgtctctcaaagggagatagagtttagggaagaaagaaggatcaactgtgtctgataccactgggagcttaagtaaagggttcttttacttcatagcatttatcccaatttgtaattcagtattatttgtgtggctgtttggtgtctctttctcctatatgagtgctagcttcataagggcaaggattttgattctttaatatttagtgcttgccacatgccctgaacacagcaggcatacaggctaaccaacatacagtggcatgaaagtcatgaaagtgagacacctacctcctccagtgccaagagagcataaccatgcacctgtcactctcctcaacaccacccccaagcatgaggcccaaaagcattagctaatcccctcctccagccactaaaacttaaaggccaggtgtggtggctcccatctgaaatcccagaacttcaggagacagcagcaggaggatcacttgaggccaggagtttgagatcagcctgggcaacatagctaggtcccatctgtactaaaaattagctgggcgttgttgcatgcctgtagtcccagctactaaggaggctgaggtgggaggatcacttgagcccaggaggtggaaacaacagtaagctataatcacagcactgaactctagcctgggcaacagagtgacaccctgcctcaaaacaattttaaaaataaataagagcaaaacttagataccacgtggtcaccccaacatgcaaaatcaagttttcccctactgagaagaatggggacttgacagctgagttacagagagataatcttcttcttcttttttttttttggtttacatcctcaagatcatgacttgtgaaatttgaatcgaatacacatgtaattccagagcaatgttgcctccgcataccatcagcaattcacttggctactggaagtcaggataagcttcccagaagagaggtaccacttgggctaccagtataaaaggatgaaaatatcagagtgatggtgttctttacaacgttgagtccctggacagcctgtccactgatgctgatatctgagcctaatgcttctctgaatgttgagattgaactttgatccaatgaaactagaacgagaaagaagataagtctttcattgttgataaggacattatgtttctcatacttgtatgattatttttccttagctgtactataattatctgcttatttgtctctgctctatgtgcttagggtacaaagttgaccaagaccaactttggttggaagcatagtactaagagcacagtactgagagcacagctttaaaaaacatgatgaaggctttaatacaggaaatgagcaggggagaggcatgtggtggttggatgtatcttccttgacacagtcagtgcagctctcagtagtcaagtccctacatgttagaagatgttaccttctgtggaattaagtggcagaacttgccttcaattattttcctttgcagaacaacaccaactgcattagttaggacacagtgctggctgcatttaagtcccaagcgatgattagtctctcactgttggtatagattcaaaccaatcagaccacctcctaaagtttgtagggcaggtaaatcctcatcttagaataaaaatcatcttaccaagtatgtgttttagaggcaagaagaaaacatatttgtttctgtaagagttttgtttaaaaaaaatataagaaaggctctcggtttaggtgaggtaatgaagttgttgatagttatcagatgacactggaatctttacttctctgaatgtgttctgtgcatctctcagtgtgggaacatagagagggagatcctccagcaatgccactgatatggtcagaaactgcatctttctttctccctgctgagatgagatggagtcctttgttctagaagacccatggtggtgccgctgggagtaacccttgagacaggaacacaaatcccaaccaatttgtggttgcagccttgagtctcactatttcccatagtgatgcgtagcagggaatggcaggtgcaccagagcaggagaggacctaatatctcccttcctgttagctttttataaagttttattgtgatcagtagcagttgggaagctacttgcagtcactgagcctcagtttctacatctgtaaactggggatagtagcatggcccctacttaatgtgctcagcaaagccactgaaaggagacagaaatgtatctaaattccctggacttttatcctacctctcttggggattgtcaccaccttcccatgtttgtcctttttggtttgatgcttgctgtcacttctttccttaggtgcctctctgtacggctcttttatcccagggattccagagttacagcacatgcataccaccatccaagcatgtttatttgtctcctgcttcactaggctgtccccaaggaacatgtggctcccggcacacacctggcacaacactgcacatgacattcacccacttggccttgaatctgacaaggaatctggcatgatgttcacccactcaggccaggtgccgagcagccctggaggcttaggggccagagggatgggaaaaggtgtctttctggggtgagtatcagtttctgcaggagggctgaatgtgagaaagaataaagagagaaggaagcgaacaagcacagcttaaacatcgcctatttctattgagttttaagaacgctgtgattttgtttgtcatgcaatccattcatcaggccaggcagacacagaacttgggtgtgagtgacgataatgagctgatataattttcacaccctcatcactgagatctctcccatcaggaatgggtcagggagctcacaggtggcagcaactgctattacaggcctcatctctaccagctcctggggcctgccctcctcccattagaaaatcctccacttgtcaaaaaggaagccatttgctttgaactccaattccacccccaagaggctgggaccatcttattggagtccttgatgctgtgtgacctgcagtgaccactgccccatcattgctggctgaggtggttggggtccatctggctatctgggcagctgttctcttctctcctttctctcctgtttccagacatgcagtatttccagagagaaggggccactctttggcaaagaacctgtctaacttgctatctatggcaggacctttgaagggttcacaggaagcagcacaaattgatactattccaccaagccatcagctccatctcatccatgccctgtctctcctttaggggtccccttgccaacagaatcacagaggaccagcctgaaagtgcagagacagcagctgaggcacagccaagagctctggctgtattaatgacctaagaagtcaccagaaagtcagaagggatgacatgcagaggcccagcaatctcagctaagtcaactccaccagcctttctagttgcccactgtgtgtacagcaccctggtagggaccagagccatgacagggaataagactagactatgcccttgaggagctcacctctgttcagggaaacaggcgtggaaacacaatggtggtaaagaggaaagaggacaataggattgcatgaaggggatggaaagtgcccaggggaggaaatggttacatctgtgtgaggagtttggtgaggaaagactctaagagaaggctctgtctgtctgggtttggaaggatgtgtaggagtcttctagggggcacaggcacactccaggcataggtaaagatctgtaggtgtggcttgttgggatgaatttcaagtattttggaatgaggacagccatagagacaagggcaggagagaggcgatttaatagattttatgccaatggctccacttgagtttctgataagaacccagaacccttggactccccagtaacattgattgagttgtttatgatacctcatagaatatgaactcaaaggaggtcagtgagtggtgtgtgtgtgattctttgccaacttccaaggtggagaagcctcttccaactgcaggcagagcacaggtggccctgctactggctgcagctccagccctgcctccttctctagcatataaacaatccaacagcctcactgaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctgtgagtaactgtccaggctcctcttctctgtttccttggacttggggtgctaatcaggcctctctttcccttatctgttttgaagatcaaaaaagatgttcaggccgggcgtggtggcttacacctgtaatcccagcactttgggaggctaaggcaagtggactgcctgaggtcaggagttcaagaccagcctggctaacatggtgaaactctgtctctactaaaaatacaaaaattagctgggcatggtggtgcacgcctgtattcccagctacttgggaggctgaggcaggagaattgcttgaacccggcaggcggaggttgcagtgagctgagatcatgccagtgcacttcagcctgggtgacagagtgaggctgtctcaaaaaaaaaaaaaaaaaaaaaagatgttcaaggagcagtagcttaagtgttggatgctacaaacatatagaggttattgtagatcttatgcagctctataaaggaataaataagcatcttccccatccatctttagtggcaagaagggttttgggatagcattgattgaggatgatctacttgacaatagtttggacccaaggaggataaggaaggaaagtagtgacggatctcattccaaacttggctgtggaaacctggcttctccttactaaactagaatttggattttacattttcccctttatgttgcagtagaagaggatgaatcctctcactggtgggatcctgccatcctagagcaggtagagagaagagtcactccccactgtgggtagtggaggcttctcacatgtcacatttcacttctacctcaatttcactcttactaagatttgggaatcataatgacaggaaaatagaaaatataaacctcattttaattctttcacagaaaggttagaaattcagtgagttgtggcaacatattttccatcttctgaccttttaacactaattgatatggcttaaattcattctattttaaaccagatttttttggagatagtctatttccaacatgttccttctaggtgacaaatgagggctgttagttcagtatttgttacaataaatgtgtgtaaaataacctcacctttccagaatcatgtcaggaatatgaatctaatgcacaaatgtataactctatgacaagattgcatatatcttttaaaatataccttcccaacgttcattttaatacccctatttcaaacaaacctgcttagcaggttatgttaaacgctcagggcagaggagtaagcaagactgtgagccagtgatgacagcaaaagcatccaggtaggatcaaaatggagtaagaaaatattcctcatccctcagggtagaactccaaagagatattcatgggtcctggccccgtagtggaggtcactcaaaggacaaacatgtttgcatctcatctgcttgaagcctggacacagaggcaccatctgtgtcactctgtgtgtggtctgccatgttgtggggtggtcactacagactcaggcagctgggcagacaataccttagccttagatgatgctgatgcagcccaggagtcagaaactgtagtgcagacaatgccctccttaggccaacacaattaagtgcaatagatgactggcttttctgttagcctcttcattggaaccaaaagcagcattactctaccaaacagaggggagctggaaagaaactacacagtttgcccagcctagcctctgccttgacacggaaccatgtgagtctagacattcacctagatcattccttggggaccaatgctgctgacacattaactcaatagtttgtcctggcctgagaggtcatgtaacttgtagaaagtttagaagcagagattagtgtcatttatttgccatggctgtgacaacaaaggaaggaacaggagtgggaaaacccaaggccaccctggttttggtagatggtgcacacgcttccactaactgttctggggcaaagatccaaatgcactattgggcctggctatgctgcttctgctgggtcccccaaacatgagcctccacgccatttctcagttgtattttaccacatattatcacagtcaccggatttgtacagaatatttggaacctatactgtcttaagggctaccctttaaagaagagaaaacaaggttttaattcaactgtctggaacattttatgtttacttatgtggaatactacatcttttgttataaacaggagggaatgtggacattcgaaggcccctaccttttagctaaaagcccatatgaagcatatggatccatttatacacaccatgcttttcagctacattttcctaatttgcctctctggggccaaccttgtgggactagcagattcatggttgagttgaaggatggtgacctcttccatcagcttttcttcttcctccagtcttccaaccctcagtaacatcagactgggaaggtcttcagacatccagaaaccccagttcggggagttcatacatgacccatcaaagatgagttgcaagcaggcctgccttagggagcaccagccttaatgggttttcctacagagatagttgatgggcagatgcaataaactgactgctttgtgattgaccaccttgagaaaaattagcatgtctggctatgttagtcttttcttgcattgttataaagaaataccagagtctgggtatttataaagaaaagggatttaattgtctcatggttctgcaggctgtacagaaagcatagtgacttcttcctctagggaggtctcaggaaatttacaatcatggcagaaggtgaaggagaagcagacagatcttacatggctggagcagaagcaagagaggctggggagaaggtgccacacattcaaaccaccagatctcataaaaactcattgtcacgaggacaacacctaaggcgggatggtgtgaaacgatgagaaactgcccctaggatccaatcatctcctaccaggccccacctccagtattggggattgcatttcaacatgagattttggtaggggcacagattcagaccatatcactggcactgtgctaatcagatgaatatcaccagttggaaggctagattccacaagaggaggaatgacctggaaattggttctttagttgtgattcttctgcacactgtcattcagggaaatatgagtcaatcatccttcccaataggtcaaatcaaccagatcatctgatcacagagactgaggtgtagctgaaagctgctcacatttctatgaggtcaatggaagccttgagcacagttgtcaatctgtagaaataaggactctgtgactcctccaagacctctctgtgaatgacggtttaagaagaaccagatcctaaaacagggtcagagcttagagggaagggaaagcataaaagcctctgagcaaattctaaagacagggtcaccataggctctcagtgaccctctgtgactgagtggctgcagtgatgcaaaatctcatcatcactgcggaagacaaaaaaatgtcaccctttctacctaggatgagaatccccaaatttggggagaggccacttactaaatagacgtaaaggaacaaagtgacctggaagaattcctgcctgaacctctcaggatcattcacatttgagaacatttatcaaatattcattccaggactgggaccatgaagacttcagctgctttgagctaatcattgtaactttttggtgtctcatggtggaggcaggaaaggacctgatgaacaaatataatcattgccgtcagagttactgttattatttcttgccttaatgttacctcgttctcttgagcattccagttcctcagtcaatgactcatcaacccctatatctataaagtcacaatcgctgtgacttgatttctgtttcactttgtagatatggaacccattcacatggactttttaagaagcttggaattccagggcccacacctctgccttttttgggaaatattttgtcctaccataaggtgagtgtttttgagctcactcttttgcttcttatgattgccaagagcagcttagttccatcagtaaaaatgcttctcctcagggggaaggtctgaagttttacactttcagaaacagtgtgtaggcatcacccagaacatggcaatgtttacccaagggctctcttgctaactctcaggaacctcaggtttgcctcagttgaacagcccaaatctcaggtagatcagcaacctgatgctcagaacttgatgtgcaaactttgtgagcgccataaagaaggttttctttttgctctatgcaggttcccaggaaggtacagtcatacttagttagtattaaaagtaggaaaaggaccccctgattgtgacttgttatctgtgtacatgagagtcaaactttcctctctgtagcaagagctcttgagtagccttttttcccttccttctggacagctttgaaactcaatttattagggagcccaggtatttacctttgggtcatttgcacctgcttcaatcctctccgaaaaatgctaaattccctgagggtatctccatggctctaccccagctcttactccccatgacatcttttgcagctttgagagacagaacaaaggggttctgctttatttcttttccttcaaaggctgcaccttatgggtgagtctgatcacagactggatataactgagatgagacagtggtggtcaatcaaactcagatatttaagcacaaaatgagtttgtggggttttttttttacacaaaggcggaatcacatgcaaaatcactagaaaggggatgatttgatgaaattattaaatatttaattttgctgaatagaatataatatgtgccacgtggaccgtgaactttggccgagcctttgtgcctaacctagtctgatgctctgcccagggtctgggccctggatggaaaattaggagcccatgtccacatggccagccgcagcagtcagctctttggcttacatcatctttcccacatacctgaggcttgtttctcagattctaattctctcaggtgagggctttgttgtctaattactatccaggaatttcatattttttccctgtgcaaaagcaataatttccccgccaccttttccaggtcaactctttagtagatgtacccccaagatgcacattcctgggacctttgtttgcacagttaaaatgtcacccctgaaatgtcgatacaggaaggtttgtttttaagtttcagtgaaaactctgagcaagtgttgtaatttgctgtgtccgatgtgtagaggggacattttctcagaacttccatgttaagctggaaaactggaaagtgagttcactttgtcattctgtcactcgttcattttctcactcaacaacatgcctcatacttacctaaatctgctagactaaaggagttccctggtgtctgtaactttccaattctgctagaactctagagcgagctcatgaaataaatgaaaaggatgacaaagagataaaacactgtgcattctcttctgatgctaattcactttcccttggcctcagtttccccatgtgcccctggaggtgatcattcagggattcatgagattttcaagacaacacatgaaaaagcaaaaagacatcagaaagacaaagaggtacttagtatttatacacaaggataagtcattcagtatccacaacacttggagagaattcaagagtgattttaaatttcccttttcaaatacctcctctgttttctcttatttcctttatgacgtctccaaataagcttcctctaactgccagcaagtctgatttcattggcttcgactgttttcatcccaattagaggcagggttaagtacattaaaaataataatcaaatattattttgtttctcctcccagggcttttgtatgtttgacatggaatgtcataaaaagtatggaaaagtgtgggggtgagtattctggaaacttccattggatagacttgtttctatgatgagtttaccccactgcacagaggacagtctcagcccaaagcctcttgggatgaagctcttgtcaacctaactacaaacagagagaagttctctgaaagaagaagatatttatttgggtgtagagtattgcaatgggaatctgcatgcctttataaactatgtgcaaattcagggaagtaaagcaagacaaagaggctccaaggaaaatatgaggaggatttcttatcagttttgaaataattatccttcgctacaaagatcagtaacaagggtgacgcctcaccaaggttggacaggcagttgctgggcaggtgtccttgcagaaatattttttttaatgttgggatggcctttgtgcaagcttgtagttttgcggagtcttttgtgatagttttgttatcaggcacacaagcatgagaatcctctcttcatagccttctttgatttatttgtcagggtttttacacacacacacacacacacacacacacacacacacacacacaactagtgacatcattttggttctaacaacattcacactggttattgtaaaacttttcgaaggttgtcctaccaaggatcccatgtgtcaccaggtgtcaagttctacagtctgaactaggctgggagcattgtgattacttttctccagactttggtggcccagggactcacagcatcatgctctgtccagtgtctgcctattcccctcttctttttttttttccttaggtgcccttttattacatgtgttgtctcagacccttctaatatgtgctcataaatacatcatatcatctccttcccacatcaattcactttcaattaaaagccaaaactctttcatttagactttggatttaaagtgcttttgaatgaagggttgagagataatagagaaatagattggcaaaccatttatactctgctgttgttgttttttaattttatctgcaagtgtggaacttttcattctgttttgttattaaatttaagccaagactttttaatagaagggtatataagcatttctttgtctataccttcctgctgaatttgaagaaatgctgaatattcttaaccactggcgggctgatggactgtgattttattttattttttatttttagttttttaaattatactttaagttctgggttacatgcatagaatgtgtagttttgttacataggtatacacgtgccatggtggtttgctgcacccatcaacctgtcacctacattaggtatttctcctaatgctatctctcccctagccccccacccaacaacaggccccagtgtgtgatgtttccctccccgtgtccatgtgttctcattgttcaactcctacttaggagtgagaacatgtggtgttgagttttctgatcttgtgatagtttgctgagaatgatggtttccagcttcatccttgtccctgcaaaggacatgaactcattgtttttttatggctgcatagtattccatggggtatacgtggcacattttctttatccagtctgtcactgatggacatttgggttggttccaagtctttggtattgtgaatagttctgcaataaacatatgtgtgcatgtgtctttatcatagaatgatttatgctttgggtatatgcccagtaatgggattgctgggtcaaatggtatttctagttctagatccttgaggaatcaccacactgtcttccacaatggttgaactaatttacactcccaccaacagtgtaaaagtgttcctatttctccacatcctctccagcatctgttgtttcctgactttttaatgatcaccatactacctggcatgagatggtatctcattgtggttttgatttgcatttctctaatgaccagtgatgatgagcattttttcacatgtctgttggctgcatagatgtcttcttttgagaagtgtctgttcatatcctttgcccattttttgatggggttgtttgctttttttcttgtaaatttgtttaagttctttgtagattctggatgttagcccttcgtcagatggatagattgcaaaaattttctcccattctgtaggttgcctgtttgctctgatgatagtttcttttgctgtgtagaagctctttagtttaatcatatcccatttgtcaattttggcttttgttgccattgcttttggtgttatatttatgaagcctttgcccatgcctgtgtcctgaatggtattgcccaggttttcttctaggatttttatggtcctaggtcttacatttaagtctttaatccatcttgagttaatttttgtataaggtgtaaggaaggggtccagtttcaattttctgcatatggctaggcagtttcaccaacaccatttattaaataggaaatcttttccccattgcttttgtgtgtcaggtttgtcaaacatcagatggtagtagatgcatggtgttatttctgaggcctctgttctgttccattgatctatatttctgttttggtacctgtaccatgctgttttggttactgtagccttttagtataatttgaagtcaggtagcgtgatgcctccagttttgttctttttgcttaggattgtcttgtctatgtgggctcttttttggttccatatgaactttaaagtagttttttccaattctatgaggaaagtcagtggtagcttgatggaaatagcattgaatctataaattaccttgggcagtatggccattttcatgatatggagtcttcctacccatgagcatggaatgttcttccatttgtttgtgtcctcttttatttcattgagcagcggtttgtagttctccttgaagaggagaacttcacatcccttgtaagctggattcctagatattttattctctttgtagtaattgtgaatgggagttcactcatgatttggctctctgtttgtctattattggtgtgtaggaatgcttgtgatttttgtaaattgattttgtatcctgagactttcctgaagttgcttatcagcttaaggagttttggggctgagacgatggggtttcctaaatatacaatcatgtcatctgcaaacagagacaatttgacttcctcttttcctaattgaatatccatttctttctcttgcctgattgccctattcagaacttccgacactatgttgaataggagtggtgagagaggacatccttgtcttgtgccggttttcaaagggaatgcttctagtttttgcccattcagtatgatattggctgtgggtttgtcataaatagctcttactattttgagatacgttccattgatacctagtttattcagagtttttagcatgaaaggctgttgaattttgtcaaaggccttttctgcatctattgaggtaattatgtggtttttgtcattggttctgtttatgtgatggattacatttattgatttggtattttgaacccagccttgcatcccagggatgacgctgacttgatcctggtggataagctttttgatgttttgctggatttgatttgccagtattttattgaggattttcgcatcgatattctttagggatattggactaaaattctctttttttgttgtgtctctgtcaggctttggtatcaggagatactggcctcataaaatgagttagggaggattccctccttttctattgttcagaaaaatttcagaaggaatgataacagctcctctttgtatctctggtagaattcagctgtgaatccatttggtcctggactttttttggttggtagcctattaataattgcctcaattcaaaacctattattggtctattcagagattcaacttcttcctggtttagtcttgggagggggcatgtgtccaggaatttatctatttcttctagattttctagtttatttgcatagaggtgtttatagtattctctgatggtaatttgcatttctgtgggatcagtggtgatatcctttttatcattatttattgcatctatttgattcttcttttttctttattagtcttgctagcagtctatctattttgttgacctttttcaaaaaaccagctcctggattcactgattttttgaagggtttgttgtgtctctatctccttctgttctgctctgatcttagttatttcttgtctcctgctagcttttgaatttgtttactcttgcttctctagttctgttaattgtgatgttactgtgtcaattttagatctttcctgctttctctagtgggcatttaatgctataaatttccctctacacactgctttaaatgtgtcccagagattctggtacattgtgcctttgttctcattggtttcatagaacatctttatttctgccttcacttccttatttacccagtagtcattcaggagcaagttgttcagtttccatgtagttgtgtgattttgagtcactttcttaatcatgagttgtaatttgatttcactgtggtctgagagacagtttgttgtgatttcttttcttttacatttgctgaggagtatattacttccaattatgtggtcaattttagaataagtgcgatgtggtgctgagaagaatgtatattctgttaatttggggtggagatttctgtagatgtctattaggtcctcttggtccagagctgagttcaagttctgaatatccttgttaattttctgtcttgttgatctgtctaatattgacagtggggtgttaaaatctcccattattattgtgtggaaatcttagtctctttgtaggtctctaagaacttgctttatgaatctgggtgctcctgtatttgggtgcatatatatttaggatatttagctcttcctgttgtattgatcccatcaccattatgtaatgcccatctttgtctcttttgatctttgttggtttaatattctttttaaaataaaatattttaaacatatgaaacattatggagaatggcatgggaaatatccacgtatgcaccacccagcttaacaaatgctctactgtcatttctaaccatggtctctttgaagagctcttttgtctttcaatgtctcttccttgtttggcccacattatccttcatcatatgaagacttgagtggctcctgtgtcagactcttgctgtgtgtcatacctaatgaactagaacctaagattactgtgtattgtacaactaagggattatgtaaagtcaggatcaaagtctggcttcctgggttgggctccagctgtagaataaggctgttgatgtttaatcaactctgtttttttcacacagcttttatgatggtcaacagcctgtgctggctatcacagatcctgacatgatcaaaacagtgctagtgaaagaatgttattctgtcttcacaaaccggagggtaagcattcatgtgttgaaattaaaatactgattgattaaatttatattttgaaattcttatatattcatagacagttgcctaaaaaatgtccaggaaggttccacgtccacttcatcctgtcccccccgaatggtaacatcttgcaatcttgcataactataaatacagtatattcatgttactatatagtacaggaaattgacattgatacagttcacagagcttattcagatttcaccagctttatgtgccctcatttctgttctatgcaaatttatcacaatcatagatttgtgcaatgaccagcatgatcaaaacgcagaacccatttgtgttctatacaaatttatcacatcattagtagatttgtgcaatgaccagcatgatcaagatgcagatccactctgtctccatgtggctccctcctgctatcctacagtcacaagtctttttctctgacagggtccatatcagagcaaactattttttattttgaggtgatcaatgtattaatatttccttttctggattgtacttttggtgccatgtttgaaagttctttgcctagccctccttcctatattgctgtttttttctaaaagtcataaagtttaatgctttactaaatgtagctctattatcaattttgtgttattttttgtataaggtatgagatttagatcaaggttcattttttttgtggcttatggctgtccaattcctccaacgccatttttggaaagatgggtatattgttaaaaatcaactgggcatacttctttgcatctctcacgtactactgtgtcccattgatcactgtgtttattattccaccaataccacactgtgttgaccctagtagctgtacactaactcttaacctcgtgtagagtgattcttcccacttttattgacttattttttcagatttgttttaactcttcctggtcctctgcttttccataaaaattcagaatgagtttctcagtgtctacaaataaacgtgctgttattttgacaagaattgaattaaatatatagaccagtttatggaaaatgtgtatctttactgtttgatctttcaattcatgaacatagtatgcctctccatttccttagattttctttgattgcttttaacatcttgtagttttcagcatagagatcctgtacatgttttgttagatttacagctaaattatttcatttttgttggaatgactgtaaatgatattatgtttttcttgtattttcagatattgattgttgttacatagaaatgtgctttgattttgtgtgttgatctggtatcctagaaccttgcagaactgacatagtagttctagaagtctctttgtatatgccttgagattttacacattgtcagttatgtcacttgaaaatagagacaattcttttatttcctttccaatctgtatgccttttatttcttttcttttgtctattgcactaggacttcccagtataatgttgagtaaatgtggtgaatttttgaattgttcctaatcttaggagggaagccttcagttctttcatcattaagcatcatttagatgaagtgggctgtttttttgtagattctctttatcaaattgaggaattttctctccctagtttgctgagtttttatcataaatgaatgctggaagtactcattataaaaaaaatggctatggaagatgaaagaaagtttcaagcatgttggcttgataggccagttccaagttggcaaaaataattatctcttttttctttctatccatgaaataaaaaattaagagacaagaatgtttatggaattgcattatttcttcaaaatatgttcctagttttaaaggtattacctactattttttttaaaaccatcacattgaggcacttctttttcacgttgcccatgctgcaggagaacataaagacagcttgtctgaggcaacatacaatccaccaaagtcacctgcttgtctgtctccactccgtctctacactgcagaagtgctaggtcttgattctgtttattgtactggaagaacacattctctaccacgtggataatttgcatgtaaaagaagactgggatatagaggctggagacgacatcagggtctcctgaacactgccgccacccccccgccccgccccacacaaatacatcccaggacactgggcatctgggataaatctctattgagcatctagcatagggcccatcacccagtagacagtcactaaatagttgttgaataagtgttcctgtttaacacattttctacaaccatggagacctccacaactgatgtaggacaaaatgtttctgctttgaactctagccttttggtccagtgggatttatgaaaagtgccatctctatagctgaggatgaagaatggaagagattacgatcattgctgtctccaaccttcaccagtggaaaactcaaggaggtatgaaaataacatgagttttaataagaaacttaaagaatgaatctggtggggacaggtataaaataagatcacagtccctttccaaggggtagtccactgaatttgagctgcctaaaaatggtcttttatctttatgtacagaaaacacatcacaaaattcattataaaatgtcacttactgctccatgctggggaaagccatgtccttctgggactagagtctgcacatttaactatgggtggtgttgtgttttgtgcttagatggtccctatcattgcccagtatggagatgtgttggtgagaaatctgaggcgggaagcagagacaggcaagcctgtcaccttgaaagagtaagtagaagcgcagccatggggttctgagctgtcatgaacccctccagctgcctgccatggagctgatattcctgctgttgggttattccagtgaccagacaaaaggagggctgtggtaatgcaacttcaatgggtctcccaagatggggcagctccgatgaggaggtggggcagctggaggaaaaggatcttctcccctgtgcacaggggccagggtttacatatccattaaattgtcaccttggatattctagaagactaaatatatcctttagggggaaaaagtgtgattgtaccaaagttttaagcatggagtgtatgggatggtggaaggggaaggcacttggtatctgttggttggcagtgagtaggttgggagagttataatggagaacttagaataactttgatcatttcatgtttttttctgaggatatcagtagaatactaaatattaaaattcctaccatttctttttcctccagtctcaaagagagagggtggtaaaaacactataggtagggcaagcctattatttgctatctacacttatgcagtaaaaacaggtgtaatctgagtttgtcctgggcagaccagggatatgtggtcactcactatagaaatttccaaatcaaattttgagagatttttttttaaccaggacattattggtcattatattttacaaaaataattctgctgtcagggcaacctcagctcaccacagctggggatagtggaattttccaaagcttgagcagggagtatagagaataaggatgatatttctaggagctcagaacagggtactgttgctttgtaaagtgctgaagaggaatcggctctgggcatagagtctgcagtcaggcaatatcacctgtcttgagccccttaggaagagttaattattctactcttgttctgctgaagcacagtgcttacccatcttgtatcatccacaatcaatacatgctactgtagttgtctgatagtgggtctctgtcttcctatgatgggctccttgatctcagaggtaggtctaattcagttcagtgtctccatcacacccagcgtagggccagctgcatcactggcacctgataacaccttctgatggagtgtgatagaaggtgatctagtagatctgaaagtctgtggctgtttgtctgtcttgactggacatgtgggtttcctgttgcatgcatagaggaaggatggtaaaaaggtgctgattttaattttccacatctttctccactcagcgtctttggggcctacagcatggatgtgatcactagcacatcatttggagtgaacatcgactctctcaacaatccacaagacccctttgtggaaaacaccaagaagcttttaagatttgattttttggatccattctttctctcaataagtatgtggactactatttccttttatttatcttgctctcttaaaaataactgctttattgagatataaatcaccatgtaattcatccacttaaaatatacagttcagtgatttgtagtacatttgaagatatgtgtgaccatcatcattttaaactttaaaactttttttgtcaatctagagacctcatacatttttagctatcagccccctgtcacaaaccctgtcatcatatgcaaccactaatcaactttctgcttctatggatttgcctattctggacacttcatagaaatgatattaattcatcagggttttttattctctagttcatgaatttgtactttagtctgtatcattttctttcttctgctggcttcaggcttagtttgcccttcttcgtttactatgttgtggcatgaacatagattactgatttgtgatttttttgttcctctaaatttagacattacagctgtaactttccctctgagcacttcctttgctaaatcccatgagattgtggtctatcacatcttagtttttgttcacctcaaaacagtttctatttgcccttttggtttctactttgactcattggttacttaaatgtttattatttaacttccacatatgtgtgagtttctcaattttctttcccttattgattttatctttattccatgataggtgacagagatatgctgtgttatttctatcttgactacctactatttcttgaacagcaagattaattttgagcttcagattatgatttgggttattctaggagactgtagtccaatagataaaggcaaagagattagggcattgaattttgttccttttatccttcaaaagatgcacaaggggctgctgatctcactgctgtagcggtgctccttatgcatagacctgcccttgctcagccactggcctgaaagaggggcaaaagtcatagaaggaatggcttccagttgagaaccttgatgtcttttactcttctggttggtagagaaaactagaattgctccaggtaaattttgcacattcacaatgaatttctttttctgtttttgttttgtttttcctacagcagtctttccattcctcatcccaattcttgaagtattaaatatctgtgtgtttccaagagaagttacaaattttttaagaaaatctgtaaaaaggatgaaagaaagtcgcctcgaagatacacaaaaggtaaaatgtggtggtagttataggaggatgtttagtttttcataattttttagataatatacatatgatcagtgcagttacctgtatgtttttaaagaatgcttttaacatgaagactgctcatgtttagagcaagagaattcatttggtagaaatgcagaaagtggggtttggggaaggagatatgagaatgagtcagagacagcacatgaaatttgatatcagacacaacaattagtatgccacggcataaattttattgagataaaactttaccactttacttcccttcaataaattgtcagaggataaacattactgtttggaaatatattttactgatattatgctttccccagatcataaattggtaaagactcatttcaagtacaaacctgttattttacacattctcaaatgaaagtccctatcaggccacctgctgaagtgtagcgtgtgttaaatttgagccatctcacatgatagccagatttgtttcaggaaaacatcctgctttccaaggatttagaagggtatgtttttcactggtgattcaggcaacatgcatcagatttctggtcttcaaggagccatattctcagaagggagatcaaggaccacgcttgtgatttacttctgacttcaggagccactttctgtcagtgaaatttctctttttgcttctagcaccgagtggatttccttcagctgatgattgactctcagaattcaaaagaaactgagtcccacaaaggtaaccagagtgtttctgagggctacttgtggggcactcagagggaaggccttgttctgaaaatgtgcaggaagtattccaggatgatgagaatttctgccacatagcagaacgacacatgtttgaatgttataagtggtagttggaggcactttctagaggcatgcaggcatagatagccatgttctaagagtaaagggcaaccctaagcaaacctggcatgctagaaagtcagtctgcggtctgtggatcacctacatcagatcaaatgccaattctcagcctccttcagatccactgaataaaaatttctgcctagaaatttattaggttgctgcaaaattaattgtgggtttttccattacttttaattgcaaaaaaatgcaattaaaagtaatggcaaaaaccacaataacttttgcagctacctaatacatctaacatccaatcaggagccacgctgttccaaaaggggtgattttaactggcagtacttgttgaaagtgtgttcaccaggttaatctactgcaaagttattttccactttggaatggattagtaacttgtggggaaaacctctgagaccgtgtaaatatcctctttgtcttcaatgtttcacctacgagttttacaacccatgtatgttttttactgaagtcactattactatgacagtggcaaaatgatgaccatggtcaattacaagccaccaagacttggcaaccatctcacaaaattcctgaatatttaactattggttctagagagcaggactgggcttactccagcatactgctttaaatatatccatgtctacatccacttttgtctgtatgtctatgtatctatctatgtatctatctagctatgtatctatctatctatctatcatctatctatctatcatctatccatctatcatctatcatttatccatctatcatctatctacttatatattatctatctatcatctaactattcatctatctatcccaatataacttgctgtgataaaggaaatagtctattgttttactgtttcatatagaaatcactagacacatatggctattgagcactggatatgtggctagtgccattgaagatcaattttaaatggtatttcagtttaatttaataaaatttgattttaaatagccactagtgggtagtggctaccatattggacagcagagctctaaactttgagattatagttcaatttcacatcagtatcatcaggttcatgataactgaatactatgattaggtagttgaatttacttataactgcatcacagaagtcttcactggtaaatcacagctctgtcgacctttctcacactcctttcatattggttttggttgtgaattacatggttggagcaggcattatatttatttctatgttccaggtctctaaaggtcctaatccagtcctgatcaaacagaccagtgatggaccatcctgagcttctctcaggagaaaaatcaagaggggcccaacttgtaatcataggagcttatgctattttaatgccatccatcagactacaatcaattaccactcatctagctttttgtccatctctcattcttgtacatcctgagatagtcaattctgagaactgtagcctagatctatcacctgatgcctctcaaagatataatccgtgcttctcaagctaggctatgcacacaaatcactgcatcttgtgaaagttcagattttgaatcagtagttcaagggtggggtttgagattttgcatttctaatgagctctcagatgcttctgacccatggaccacactttgaataccaagaagtggtctgtagaccaatattggtcccttaagttccctcaaacatatcttcgggaaacgtcctttgattttccctacatttaaccattagtgttgcaaattctctcaaagtttgtcaagatatattgtagctaaaataaattacatttttcttgggggagagtactacctcatattaacttacaataaagtacttttaggatcattcaaggaacacacccataacactgagtatgttatgcggaaatgctctctctggaaattacacagctgtgcaggtggcgggggtggcatgaggaggagtggatggcccacattctcgaagaccttggggaaaactggattaaaatgatttgccttattctggttctgtaagatacacatcagaatgaaaccacccccagtgtacctctgaattgcttttctattcttttcccttagggatttgagggcttcacttagatttctcttcatctaaactgtgatgccctacattgatctgatttacctaaaatgtctttcctctcctttcagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggtgagtggatggtacatggagaaggagggaggaggtgaaaccttagcaaaaatgcctcctcaccacttcccaggagaatttttataaaaagcataatcactgattctttcactgactctatgtaggaaggctctgaaaagaaaaagaaagaaacatagcaaatggttgctactggcagaagcgtaagatctttgtaaaacgtgctggctctggttcatctgctttctattactacaataatgctaagtaaaaaacctccaaaaacctcagtggcatctaacaataagcatttgttgctcacactcatttcacattggttttggttgtgaattacatgtttgcagcaggcaccatagtggtgtgtgatgtccccttagctgtatccacatatggacacaggaatttgctctttttatctctttttattttcttggttacagacatgtgacttttttttttgaaaggtaacaatcactttctcatatgttatttgatgctagtggtcatagcctattagtcacatttgtttcaatgagaaagaaaaaccagtacacggttatgctaaggatttcagtccctggggtgagagccgtctcgaatgtctccccacttcataactcctccacacatcatagttggatagtgagctctgctgatattggcaggacttgctctggtctggctgtagtctgacggagcctggccctgggtgtgctgtgcaggctgactcagctctccccacacctatctcatgttccagtcaggcagtaactggtgaagaagccaagctaggaaccaggatatctggctcctgagctaaagtcttaaaacactatcatattgccttccaaatataacaccaaatactaggtgcatatcacccacactgttttcagacctctgccaaaattgggattctttgtggtatgaagagacacggctttggggctggcccggctgtggcagtgaggtgaacacaaagggatgttcttcagagattacagtccagccctgaagcaacaactaggagactgtttcagcaagtgaggacagggctgtgtggggttctatcctctttataacttccactagcactgaaatcgtgttctctggttacatccaaccagaaccttctttgtcatttttgggatagaaagggactagtttatcctcaaattatttatggagattttatataatatagtgtttctctccacattttctgtatataacaaaagtcctccttttagtgtgtgtatacacatatatatacacatatatatgtgtgtgtgtatgtgtgtgtgtatatatatatagacatatatacacggttatgctaaggatttcagtccctggggtgagagccttcccgaatgcttcccaccttcataactcctccacacatctcagtgggccactgagcacagcaatgggcatgacagttattaaaacactttataaatgcttcgatcctttaccagtatgagttagtctctggagctcctaatacttcattagtactgcatggactgagttaaaagttaattcaaaatctcaatttatccaaatctgtttcgttctttccaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaaggtacaaggcccctgggaagggagccctccctgaaccagcctggttcaagcatattctgcctctcttaatctacaggacagtcatgtggttgtataattatttgcttgtatttttatatttagagatttttttaatcatcaaattgattattgtcacactttacaaaccatagactagaaaaaagaaaactacagtcatccacaattccaacaacttacgatgaaggtcatcagttatgtccttatgggtcatcagtgtccaaaatgtaaggactcttttaaaaacacatgatcacaatgctattattatgtcccccaaatgaatatttttttcataaatataatcaaatatttaggaataacattttaataaaaaacatgcatctaatcttcaaagaattttatagcttactggaacagatagacaaagaaagcagtgatgatactgcattacatcggtacagtagcatcatatgcctgtgtaaattatctgacttcaactattctatggaggtgtgggggagaaagagggagagatggagagaagaagaaggaggagaaggagggagaagacaaggtaaggaggagaaggaggagaattagaaaaacaagagaggagatgagaaggaaagtgcaaaataacaattttgaaatagtacaagacaatttccccttctccttcctcatgaccaatgtaagtgtgacttgaggcaggaacctacttttccatcagtcagtcccatcacttatgtgccttttatagtgtggacacatcaccaccctgaatataatttcagtgtttagaaataagtattctttgcaacactatttatctcatctcaacaagactgaaagctcctatagtgtcaggagagtagaaaggatctgtagcttacaattctcatagcaaaataagcatagcaggatttcaatgaccagcccacaaaagtatcctgtgtactactagttgaggggtggcccctaagtaagaaaccctaacatgtaactcttaggggtattatgtcattaactttttaaaaatctaccaacgtggaaccagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacaggttagtcaattttctataaaaataatgttgtattaataattcttttaactgagtggtctgtattttttaaaaagaatatgcttgtttaatcttttactaatttgttctctgggccaaagaatcaattaggcccatctgtgatctttaagggtgcttcagttctggagttcaaaagctgtagcatcaaaaacatcatgtaaagcccatgtagattagcatggcataattatctgcagtctccttgaacttgagcaaagtttacattcagtttcaagtcgattggaaagatggggaagtattttgcacagtcatgaagtgtaatgattaccttgttgtgacttttgaatgctgctcttcccaaccagaacttggagaagctttctcatgagagtggctcccaaccactagctgtacattggaatcaccagggagctttaaaaattcatgatgtctgggatatcacagaaattctaaactaatttgcccagagtgtggctttaaaagcttccccattgcttctcatgtgaagccaaggttgagaatgactaatttaaggcatttctggtggatataaaggactaccacagtccaaggccatcctgactgacctcaccttccaggtgcctagctccatccagctgggctccttttcaacccaattataactctattaatgttgttcccagccaggcatggtggctcatgcctgtaatcccagcactttgggaggccgaagcaggcggatcatgaggtcaggagatcgagaccatcctggctaacacggtgaaaccccgtctctactaaaaatacaaaaaattaccctggagaggtggcaggcacctgtagtcccagctactctggaggctgaggcaggagaatggcatgaaccccagggagcggagcctgcagtgagccgagattgggccactgcactccagcctgggtgacagcgagactctgtctcaaaaaaaaaaaaatgttgttccctttctcctcattttgttcttatctttcaagtcctagttcaatccccaagcccctccaaagtgtcttctcctcctagtccagggcccatttacttctctgctctgttattggatactggaggctattatcataaatttgacaatttgccattaaatcattgagttttattctctatattttctttgtatctaaaatgtcttcccccctccattaacaatatcctctcattttattcctttttaaaatatcccagtggtgccttgcaagggactgtatctaatgcaagcatttggtaaatgtttaaggagtgatgtgcagttgatggcttgcatacatatattaagctatttaatgtgaacctttaaacaaatgccattcgtgcatatgcatgtgtgtgtgtgtgtgtgcacatgtgggcatgcatgtctgtctgcagtgaaaatatattcagggtttttgaaaatttttaaataataaggtattatatttatagaaagatttgaaatattttctctgaagaagttaaagaacagacgtcattgattcatattaaacaataccctataaatcttatttctaggtctcatgtatttattattcaattccaccccttaagtaggctttctatataggagaggaagaagacagaaatagtttccatattatttccatattccatattatttgtggctttaggccagcagtgtagctgtattatatgtgcccagacaggggactcagccctgaataaaagtggtcctctggcacacctgggatggggaaggtactccttggtaagctcccaacctggcacttcttgatctccctggcaattttcttgcccattactccatggagatcagaatatcactctgttgtgtcccctcaacacggaaggagtgtctcaataagaatggggctaaaagttgagtccaaacactgtaggaattgagaggttccccacttgcactacccttggaagccaagagaagatgttaaaaaataaaatggtaatgcttcctgaaggtgtcttcccatctttacactggatgggttcaattgggaggaattactggactctggaagttgaagactgtccatataattaaaatgtacaataactacccaggtttaccttgcaagtttcaacatacacaaaattaactttatatgactcttcaaaaacagtttgccatcatacctaataatctggtttaaattttaaaaactcatccattttacttaaaatttaaatcaaaaaagaacacaggtttccatgaatttgtctcaggcctggcacagaatagtactccataaatattttgttaaatgatagatgatgaatgctctcactgtccaatcttcacacatcttatagactaagtataaagaatccaagatttatagtgctgaaagtagtttttatatgtttacaaagcattattgtcattactgcattttttttgcccattactccatagagatcagaatatcactctgttgtgtcccctcaacactgaaggagtgtctcactcactttgatgctatactttctacttttgtttatttaatgcttctcaatatgcttgtttaactgttgcagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcctaaaagcactcattccttttcttttccaaattcttcctttattttcccttcctgaataatttagtcctaaagccattaggtgggtggcagccagatggtggccacacattaaggtagagaagagagagtcatggtggctccaagtcagagaccaaggaggttcatgtggagagacatcctggcctgggtgtgggagtccaagcaagcagagaaggggtcgacgcagaggggtggcttgcaagagcagccagagcctaaatagggtatggagaacccacatgaggcgaggagggcatccatgagtgggaggggttgggtgaggtttggctacataaaggggattgatcaaataagtaaatgtattaaggatgatagaagccaggcttctcacctttgcagaagggagtcatggattcagaaagggagaaaactagcatgaatcctatgaaattagattggaatggatgtaaccgtgtatattcatacccttgtagatagatagatgggtagatagatgatagataggtaacagatagatgacagataatgagatagatagatgtaaatgtatgtctgtatttgtgtgtgtgtacaaaaaacatatattccctacttctctccactgatagggctaggtaacaatgacatttcaatagcaatgaacacacttagtgccccgatcttggcttatgaataccattttccactgaagggaaccagagctctttagagaaatggctgatgccagggcaagaattaagaatgttcaagataagtttaggacacattttgtgccaggaagcaagaaaattttcaaataatttccaagtaatctttggaaatgatacttgaaaatgacttccaaatgacatttccaaatgacttgcaaacgatttccaaatgatatttggaaaaacctaaagactccatcaaagaactattggaactgataaacacattcagtaaagttgcaggatacaaaatcagcatacaaaaatcagtagcatttctatatgccaatagtgaacaatctggcaaaaataaaaaagtaatcccatttacaatagccacaaataaaactaaatacctagaaattaacttaatcaaagaagagaaaggtctctacaatgaatactgtaaaacattgatgaaaggaattgaagacacaaaaaaggatatttcatgtttatatattgtgagaatcaacattgttaaaaatgtccacactactcaaagcaatgtacagattcaatgcaatccctcaaaataccaatgacattcttcaaataaatagaaaaaaatcccataatttgtatggaaccacaaaagacccataatagccaaagctatcttcagcaaaaagaacaaaactggaggaatcatgttacctgacttcaaattatactacagaggtacagtaaccaaaacagcatggttcttgtataaaaacagacacatagaccaatgaaatagaaaagagaacccagaaacaaatgcaaacacctacagtgaactcatttttgacactgctaccaagaacataccctggggaacagaacatctcttcaataaatggtgctgggaaagctggatatcaatatgcagaagaatgaaactagacacctatatctcaccagacacaaaaatcaaatcaaggtggattaaaggctgaaatctggctgagcagggtgactcatgactgtaatctcagtactttgcagaactttgagaggtcaaggtgggcagatcacttgaggtcaggagttcgagaccagcctggccaacatagtgaaaccccatctctaccaaaaaatacacaagttagctgggcatggtggtgcattcctgtagtcccagctagtccagaagctaaggtgggagaatcatttggacctgggaggtggaggctgcagtgggccgagatcattccaatgcacctcatcctgggcaacagagtgagacagactgaagtctaagacctcaagctatgaagctgctacaagaaaacattgtggaaactcttcaggacattggtctgggcaaaaatttctgaagtaataccccacaagcacaggcaaccaaagcaaaaatggacaaatggaatcacatcaagttaaaaagcttccgtgccgcaaaaaaagtaatcaacaaagtgaagacacaaaccacagaatgggagaaaatactttcaaactaacattctgacaacagattaatagccagaatatataaagagctcaaacaactctgtaggaaacaatctaataatccaatcaaaaaatgggcaaaagatttgaatagatatttctctctctcttttttttaattttgagacggagtctctctctgtcgcccaggctggagtgcagtggcactatctcggctcactgtaagctcctcctcctgggttcatgtcattctcctgcctcagcctcccgagtagctgggactacaggtgcccgccaccatgcctggctaatttttttgtatttttagtagagacggggtttcactgtgttagccaggatggtctcgatctcctgacctcgtgatccacccgccttggcctcccaaagtgctaggattacaggcgtgagccaccgcgcccggcctgaatagacatttctcaaaagaagacagacaaatgccacataggcatatgataaggtgctcaacatcattgatcattagagaaatgaaataaaaaactatagtgagatagcatctcaccccagctaaaatggcttttatccaaaagacaggcaataataaatgccagcaagaatgtggagaaaaggaaacccttgtacactgttggtgtaaattagtataaccactatagagaacagtttggaggttcctcaaaaaattaaaagaaagctaccataagatccagaaatcacagtgcttcggtatatacctgaaagaacggatatccgtatactgaagagatatcttcacgctcatgttcacaatagccactactcacaaatgctaagatgtggaagcaacctaagtgtccatcaacagatgaatggataaagaaagtgctccacttatacacaatggagtacaattcagatacgaaaaaagcatgagatcttgttatctgtaataacatggatggaactggaggtcatcatgttaagtgaaataagccaggcacagaaagacagacattgcatgttctcacttatttgcaggatctacaaatcaaaacaattgagctaatgtctgggtcttagtcaattttgtaccctaagtactgtgagcacagcttttaaaatacatgatgaatgctttaatacaggaatgaatagataagaggcacagggtgcctctgggtgttcttctgatacatagtatcttccttgacacattcagtacaactctcagcaggtaagtctcttcatgttatgttaccttctgaggaattaggtggcagaacatgccttctactattttcctttgcagaacaagaccagttgcattagttgggacacagtgctggctacatttgagtcccaagcaacgattagtctattgctgagagtaattagtctatttctacagacttagaggggatgacacacaggggcccagcaatctcacccaagtcaactctgccaacctttctggtcacccaccatgtgtacagtaccttgctagggtccagggtcatgaaagtaagtaataccagactgtgcccttgaggagctcacctctgctaagggaaacgggcacagaaacccacaatggtgctagagaggaaagaggacaataggactttgtgaggggataggaggcacccagaggaagcaatggttacatctgtgtgaggaggttggtaaggtaagactttaacagaaggggtctgtctgtctgggcttggaaggatgtgtaggagtcatcgagggggcacaggtacactccaggcagagggaattgcatgggtaaagatctgtaggtatggcttgtggggatggatttcaagtattctggaataaggacagccatggaaacaaggacaggtgagaggagatttaacagatttcatgccaacatggcacatgtatacatatgtaacaaacctgcacattttgcacatgtaccctaaaacttaaagtataataataataaaattaaaaaaaaatagagttcataccaatggccccacttcagtttctgataagaactcagattccttggactccctgataacactgattaagttgtttatgattcctcatagaacatgaactcaaaggaggtcatcaaaggggtgtgtgtgattctttgctactggctgcagctgcagccccgcctccttctccagcacataaacatttcagcagcttgtcctaagactgctgtgcagggcagggaagctccaggcagacagcccagcaaacagcagcacacagctgaaagtaagactcagagaagacagttgaggaaggaaagtggcaacggacctcatcccaaatttggcggtggaaacctggcttctccttgctgtcagcctggtgctccactatctgtcagtaactgtccagattcctctcctctgttaacttggacttggggtgctctcaggcccctgctcccttatctgttttgaagatcaaaagagatgttcaaggaggagtagattaattgttggatgctacaaacacataaaggttattattgatcttatgcagatttatgaataaataaataagcatttgtcccagctaccttctcattttggtaactaggagggtttagggacagcatttggtagtgggaatgatctgattaggttagatttgacctatactaatcaacaaaaacccagcaaaggcagattacaaactgctgaacacgatggggagtgtgatcctcatccccttcccaggttctcaggattctggggacaggagggagcagcttgggtttttgtctcattaccttcattttctgggttctctgtctgctggaagagatgtgtagaagtttgtcccctgtggacctggtggttcctgctcccccaacttccaccccaggatatcatttacataacgcaccggggaacaccaagacttcacgggaagctgtcccccggctcttccctctttcctgtgccatgtcccaaaacatcccctcccacctatgactcactcctccaccctgtcatacacagaactatttaccttgcaatgattaatctccagagcaaaggagacttggaggaagttttgaagatttattctttgctttaatctttttcctcccgtctctgggaggctagcattaatatagagctttgtttctcacctaatgggaatctgctagcagcctgaaaaggcaggagctgtgaaagccaatttggattttacacattttttcccctttgtgttacagtaaaggaggatgaaccctctcactggtgggattcctggcatcctagagcaggtggagagaagagttacttcccactgtgggtagtggaggctccacctgttccattaacttctacctcaatttgacttttattaagagcagggaaccacaatgacatgaaaatagacactataaaactaattttaattctttcacagaaagcttaggaattcagtgaatagtggcaacatagtttccattttctaacattttaaaataaattgatatggtttaaattcattcatttttaaaccagaattttttggagatagactatttccagcatgttccttctggatgataaaagagggctgttagttcagtatttgtgacaataaatgtgtgtaaaataacatcacctttccagaataatatcaggaatatgagtctaatacatgaatgtatatctctaagacaagactgcatatgtctttttaaatatacatgcctgacagtttattgtaatacctcctttttgaatatacctgcttagcaggctaccttaaactctcaggcaggggagtaagcaatactgtgagctagtgatgatagcaaaggcatccagataggatctgcatgaagtgagaaaatattcctcagctctcagggtagaactccaaagagatattcatgggtcctggccccacagtggaggtcactcaaagggcaaacagattggcatctcatctgcttcaagcctggatacagggacatcaaatgtgtcactctgtgtgtggtctgccatgttgtggggaggccactacagactcgggcagctgggcagacaataccttagccttagacgatgctagtgtagcccaggaatcagaaactatagtgtagaccgtgccctccttaggccaacacaattacatgcaatagatgacgggcttttctgttagcctcttcattggaactgaaagtggcattactctaccaaacagaggagagctggaaagaaactaaacagtttgcccagcacagcctctgccttgacatggaaccatgtgagtctagacactcacctagatctttccctgggggccaatgctgctgacacattaactcattagtttgtcctggcctgagagatcatgtaacatgtagaaggtttagaagcagagattagtgtcattaatttgccatggctgtgacaacaaaggaagaaactggggtgggaaaccccaaggccaccctggttttggtagatggtgcacacacttccactaactattctggggcaaggatccaaatgcactatatgctgcctctgctgggatctccaaacacgaccctccatgccatttctcagttgtattttaccacatattatcagagtcactggatttgtacagaatgtttggaacctatactgccttaagtgctacctgttatagaagagaaaacaaggtcttaattcaactatctggaacattttatggttacttatgtaaaatactgcatcttttgctatcaacaggaaggtacatggacattagaaggcccctgcctttcagctgaaagcacatatgaggcatatggatccatttatatacaccatacttttcagctgcattttcctaatttgcctctctggggccaaccttgtgggactagcagattcacggttgaattgatggctggtgatgtctgccatcagcctttcttcttcctctagtcctccgctcctcagtaacatcagactgggaaggtcttcagacatccagaacccccagttgggggagtccatacatgacccatcaaagatgagttgcaagcaggcctgccataaagagcagcagccttaatgggttttcctacagagatagtcaatgtacagaggcaataaactgactgctttgtgattgatcaccttgaaaaaatgagcatgtctggatatattagtcatttcttgcattgctgtaaagaaatacctgaggctgggtaatttataaagaaaagagatttaattggctcatagttctgcaggctctacaggaagcatagcgacttctgcctctagggaggcctcaggaaatttacaatcatggcagaaggtgaaggaggagcaggcggatcttacatggctgtagtagaagcaagagagggtggggaggaggagccacacacttataaaccaccagatctcataaaaactcattgtcacgaggacaacagcgaaggcaggatggtgtgaaaccatgagaaactgcccctaggatccaatcacctcctatcaggccccacctccagcatttggggttacatttcaacatgagatttgggtaggggcacagattcagaccatatcactggcactgtgcttatcagatgaatatcaccagttggaaggctagattccacaagaggaggaatgtcctggaaattggtttcttaagttgtgattcttctgcacactgtcattcagggcaatatgagtcaatcattctcccccatagctgaaatcaaccagatcatctgaccacagagactgaggtgtagctgaaaggtgctcgcatttctacgaggccagtagaagcctggagcacagttgtcaatctgtagaaataaggactctgactcctccaagacctctctgtgaatgacagtttaagaagggccagatcctaaaacagggtcagagcttagcagaaagggaaagcataaaagcctttgagcaattctaaagacagggccacaataggctctcagtgaccctctgtgactgagtggatgcagcgatgcaaaatctaaccattactgctgaagacaaaaaaaaaaagtcaccctttctacctaggatgagaagccctaaatcagtggggtccacttactaaatagacataaaggaatgaagtgccctggaagaattcctgcctgaacctctcaggagcactcatgtttgaggacacttatcaagtattcactccaggattgggaccatgaaaacttcagctgcttttagctaatcactgtgacttttggggtgtcacagtgcaggcaggaaaggacctgatgaacaaacataatcattgctgtcggagttactgttatttattgccttaatgttacctccttctcctgagcattacatttcctcagtcagtaactcaccatcccctatatctataaagtcacaatccttgagacatgatttctgtttcactttgtagatatgaaacccattcacatggactttttaaaaatcttggcattccaggtcccagacctctgctttttttgggaactactttgtcctaccatcaagtgagtgtttttgagctcactctttggcttcttatgattgcaaacagcagcttagttccatcagtaaaaatgtttctctgcaaaaggaaggtctgaggttttaccctttcagaaacagtgtgtaggcatcacccagagcatggcaatgtttacacaggggctctcttgctaactctcaggaacctcagatttgcctaatttgaacagcccaaatctcaggtagatcagcaacctgatgttcaaaacttgatatgcagactttgtgaacaccataaagaagattttctttttgctccgtgtaggttcccaggaaagtacagtcattgttagtattaaaagtcggaacaggatcccttgattgtggcttgttatctgtgtacatgagagtcaaactttcttctctgtagcaagagctcatgagtagccttttcccccttcctcctggacagctttgaaactcagtttattagggagatcaagtatttaccattgggtcatttgcacctgcttgaatcatctccaacaaatgctaaattccctaagggtttttccatggctctaccttagctcttactccccatgacgtcttttgcagctttgagacacacaaaaaaggggttctgctttacttctttttattcaaaggctgcactttattagtgagtctgaggaaggagtggatgtaactgagatgagatagtggttgtctatcaaacttggatctttttttttatataatactttcagttctagggtacatgtgcacaacgtgcaggtttgttacatatgtatacatgtgccatgttggtgtgctgcacccattaactcatcatttacaaggtatatctcctaatgctatgcctcccaccgcccccaaccccacatcaggccccggtgtgtgatactccctttcctgtgtccaagtgttctcattgttcaattcccacctatgagtgagaacatgaggtgtttggttttttgtccttgtgatagtttgctgagaatgatggtttccagcttcatccatgtccctacaaaggacatgaattcatccttttttatggctgcatagtattccatggtgtatatgtgccatattttcttaatccagtctatcattgacagacatttggcttggttccaagtctttgctattttgaatagtgccacaataaacatacgggtacacgtgtctttatagcagcatgatttataatcctttgggtatatacccagtaatgggatggctgggtcaaatggtatttctagttctagatccctgaggaatcgccacactgacttccacagtggttgaactagtttacagtcccaccaacagtgtaaaagtgttcctatttctccacatcctctccagcacccgttgtttcctgacttttcaatgatcgccgttctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatgagattgcttgtttttttcttataaatttgtttgagttctttgtagattctggatattaaccctttgtcagatgagtagattgcaaaaattttttcccattctgcaggctaccttttcactctaatggtagtttcttttgctgtgcagaagctctttagtttcattagatcccatttgtcaattttggcttttgttgccattgcttttggtgttttagacatgacgtccttgcccatgcctatgtcctgaatggtattgcctaggttttcttctagggtttttatggttttaggtcttacatttaagtctttattccatcttgaattaatttttgtataaggtgtaacgaagggatccagtttcagctttctacatatggctagccagttttcccagcaccatttattaaatagggaatcctttccccattgcttgtttttgtcaggtttgtcaaagatcagatggttgtagatgtgtggtgtttgttctgaggcctctgttctgttccattggtccatatccctgttttggtactagtaccatgctcttttggttactgtagccttgtagtatagtttgaagtcaggtagcgtgattcctccagctttgctctttttgcttaggattgtcttgggaatgtgggctcttttttggttccatatgaaatttaaagtagttttttttccaattctatgaagaaagtcattggtaacttgatggggatggcattgaatctataaattaccttgggaagtatggccattttcacgatattgattcttcctatccatgagcatggaacattcttccatttgtttgtgtcctctttgattttgttgagcagtggtttgtagttctccttgaagaagtccttcacctccctttaatttggattactagatattttattctcttagtaacaattgcaaatgggagttcactcatgatttggctctctttctgttattggtgtataggaatgcttgtgatttttgcgcattaattttgtatcctgagactttgctgaagttgcttatcagcttaaaaggattttgggctgagacgatggggttttctaaatatacaatcatggcatctgcaaacaggaacaatttgacttcctcttttcctaattgaataccctttatttctttttcttgcctgattgccctggccagaacttccaatactatgttgaataagagtcatgagtgagggcatcgttgtcttgtgctggtttcaaagtttttgcccattcagtatgattttggctgtggttttgccataaatagctcttattattttgagatacgttccaccaatacctactttattgagagtttttagcaggaagggctgttgaattttgtcgaaggccttttctacatctattgagacaattatgtggttttttaatcgttgattctgtttatgtgatggattacatttattaatttgcatatgttgaaccagccttgcatcccagggatgaagcccacttgattgtagtggataagctttttgatgtgctgctggattcagtttgccagtattttattgaggattttggcatcaatgttcatcagggatattggtctaaaattctctttttttgttgtgtctctgccaggctttggtatcaggatgatgcaggcctcagaaactgagttagggaggattccctcattttctattgattggaatagtttcagaaagaatggtaccagctactctttgtacctctggtagaattcagctgtgaatccatctggtcctggactttttggttggtaggctattaattattgcctcaattttagggcctgttattggtctattcagacattcaacttcttcccggtttggtcttgggagggtttatgtgtccaggaatttatccatttcttctagattttctagtttatttgtgtagaggtgtttatagtattgtctgatggtagtttgtatttctgtgagatcggtggtgatatcccctttatcattttttattgcatctatttaattcttctctcttttcttctttattattctggctggcggtctgtcaatttttttgatcttttcaaaaaaccagctcctgggtttcactgattatttgaagggttttttgtgtctctatttctttcagttctcctgtgatcttagttatttcttgccttctgctagcttttgaatgtgtttgctcttccttctctagttctttgaattgtgatgttacagtgttgattttagatctttcctgctttctcttgtggtcatttagtgctataaatttccctctacacattggtttacatgtgtctcagagattctggtatgttgtgtctttgttctcattcatttcaagaacatctttacttctgccttcattttgttatttgcccagtagtcattcaggagcaggttgttcagtcttcatgtagttgtgtggttttgagtgagtttcttaatcctgagttctaatttgattgcactgttgtctgagagacagtttgttgtgatttccattcttttacatttactgagcatgctttatgtcccattatgtggtcaattttagaataagtgtgatgtgatgctgagaagaatgtatattctgttgatttggggtgtggagttctgtagatgtctattcagtccactgggtgcagagctgagtggacatgaacattttatcaaagaagaaacacagctatcaaaaatccagaaatattgaaccttgttaataataaagtggctggcctctggttcattcctgtaatctcagtcctttgaaaggctgagaaaggaggatcacttgaggccacaagttcaagaccatcctagacaagtcagttcaagaccagacttcatgtctacaaaacatcaaaaaattagccaggcatggtgatgcatgcctgtcatcccagctactcaggaggctgaggcaggaggattgcttgagcctgggagattgaagtggcagtgagccatgattgtgccattgcactccagcctgggcaatgcatcaagactctgtctaaacaataataataataatagtaatagtaataataataataataaagaaaacggttgggacgccattccttacttattcaatacacaaagttaaaagcaatttctactttctctatttttttattactaaaaaaagctgaaccattctcacagcctgaaatgcttctcaccttcccctcttctatacaaacacttctctgttgatgataatgcagacagtctctcctttaggaatacttcacaccaggtagttccagatccccttatctctgccttcccagagctcctggtgtctccccagttccctctgtgtggtgaagtacccccaccttgggtctcagcatgactcgttctttgaaggtcttgttcacattttcccttatggttctgttcccctgtgttgtgtcacagcactgggcagagtggacaacccattcacaccgatagagagggccccatggttctggagataaccatgtaactgatcagaatagggcattgagggctgggtgtcaggcatgggctgcacttgggtgggcaggccccctggaaagtcacaggatttggcaagcttcctagtaacatctctccctggggtcctcttggaacttcatgcccgatgctggatgctggtttattctcgagagatggttcattccaataatcaatgaaactcatgtcccaactaaagttcataaactccagtttgtaaactgagataatctcagctgaatgaacttgctgaccctctgctttcccccagcctctcagtgcccttgaaatcatgtcagttcaagcagccccatgaggcattacaatgtttagttatttcagtgtttattaaaccttgccctatgctgaccccaggtgaatcacaagctggacttctgacaaggacaagctatgatattcttttcaattacagaaaaagtaagttaactgataggattttttaaagatgttactagttttggaaaggtaatttgtgcacatggtaaacaagaaggtataagaggataatgcttttatactgctgagaataatgttttctctaattttttttggtagatgctttcatcagattaataaaattcactgctgttagttgttgaaggttttttatatcatgaatgggagttgaatattatcatgtattattaatatattattattgaactagcaaaggctcttcctaaaacaattgagatgatcttataatcattctcctttaatctgttgatgagatcattggtatttatactttttctctgttaactattcttgagtctcaggtttaaattcaacttggtcatggtgtatcatctttgaacactcctgtctctggcttgctactattgtgttcagcatttttgcactgatgccgatgaatgagactggcatgtcatcttcctttgcggtcctgatttttttcagatttggatcatgtggccctcattgaatgagttgggtgtgatgccttctttttcatgtaactggattgatgggacactttggagtctctccagatggccctcaatggtccctgcctcctcattgttaggctcctaggcaaccctttctcatttctggtaggcccaggaacctgtgggttttatgtttgtttgtttgtttgtttgtttgttttttgagttggagtcctgctttgtctcccaggctggggttggagtgcaatggcctgatctcggcccactgcaacctccacctcctgggttcaagtgattctcctgcctcagccttctgtgtagctgggattacaggcatccaccaccactcctggctaatttttgtatttttagtagagacggggttttacaatataggccattgtgatctcttggacaggctagtctcaaattcctgacctcatgatctgcctgcctcagcctcccaaagtgctgagattacagttttgtgcctccacacacagtgaatctgtggtttttaaaagctcctcatgcatgtgaattctgtgagcatcccgggatgacagccactgtgtgtccagctgttaaaactgtgagaaagcaccagcgggaccctctccagcatttgcttgctgtggtcatgaaagaggcttgttggggagatgatgccctggttgactcctgaaggatggttaggaatgcaccagatggaagctgggttggacccagtctatgctaaagaacagcttgtgtggacacaaggagacacgaacacatcatttttgcagagcctggggagtagccaatcgcaccatttgcttaaaacaccgtgtacagttggagaagtggactgagacaggctgaagaagctaacagtggccagatgagaaagggtcttgtgttacttcctagatatacttagattttatcctgtgagtgataggaacagttgcagggactgaagccaaggaagcatgctttaagattccatgttttttgagatgctgtctggtggctgagtagggaattccctggataagtactgcccagggtaggcaaaagaagctaggaggttactgaaataaggagtatgagaaatggtgtaggttttgctgatgttttgtaacacatctcatgacaatcttcatttccttcaccaatttcctgtttcattaattcccttccacgtgctcttctgaaatttgcctcatattctttgatttctcttttacatgttggtttcatcaccttttactttttgctttcctggaaacacaaatgattctgattgtgacatgtcagaattatttgcaacattcccctttctgctgaaacatgagctcactgaatacacaatttagtaaagtgtaggatgcacatgttgttttcatggtcataaccagctctgtagcattttataactacactggcagtgtgctgggaggtgtagagagaaatatttatctcatgtgtggctgacacaacctgccaagttgttttaggagccttcttggaatcccagcaagaacaccactgatgcaatttgaaatcacaatgtcctgctccatgccctggcttcatggcttagtcacgtctgaagtctatttctaactatctgtttccacatctataaagcatgagttaaatcatcctaatactactcatcttacaaagttttcttgctgatattaggagagttgggaaagaactgtataaattatgaagtgccatggagatgttggtggttactttatcaagaaatagacactccagaatagagtagaaagaaaacagttatgattaagtcctcctcctcttctttttttttaatttacaaagaaaggtttaattgagtcacagttccatatggttggggaggctcagaaaacttgcaatcatggcagttggcaaagtggaagaaggcaccttcttcacaaggtggcaggagagagagagctcctcttcttttttgttgtaaagtctacagaagtgcatatacttcagggcaagggcaggcagggagaagaaaggacattgcttcaccccagtcctcactgacaagtttgctttgggacttcattttgtcccagcatatgggacagagctctggccactacccattcagaaggcctgagctgcattgctagttccccactaactctgtgtgtccttgggcaaggctgggcttatgtcaaaagattatgaccctgggctctccagctacagaatctacatatgaatcctggctctgctagagcaattagtgacgtaaccttggatgggtcagttaaccttcctgtggcttagtttgctcatctgtaaaatagggatcataacaacatcaataccatgggttgttagacagattgaatcagttaatgcagggtaaatacttagcatgacacgtattcactatcatttccttgagtaaaagctgagtgtgagtgggtgtgagaatgtgtgaaaccctttcactgcaatctcagttaagaaacccatccataatttaaagttcagggcctaaatgggtggttatcttctcccagttgcatcctatcccacctttgctcttctcctgcctgtaggagctgttggtctttgattgggctggaagacctggtggaccctaagtgatctataagagaatgagaatagaggacagggaatgtcttcaaaactcctagagggacacagaggctgagaggcaggcagtcctgcaggggtcttctgattgggacaaggaggaccttggtcttcataggccaattctggtcaatttcccccatggacagatgaggaaacagatccaggaatatccaaggtctcacacttcccatctgtcaagtcttgttgattctgttgtattcatgtctttcaaagagagagagagtttaaggaaagaaagaaggatcaactgtgtctgatatcactgggagcttaagtaaagggttcttttacttcatagcatttttcccaatttgtaattcagtattatttttgtcactgtttagtatctctttgtcctattagagagatagcttcatcaggacaaggattttgattctttaatatttagtgcttgccacatgccctgaacacagcaggcatacagactaaccaacatacagtggcatcgaagtgagacacctacctcctccagtgcctagagtacatgtccatggacctgtcactctcctcaacaccacccctaagcatgaggcccgaaagcattgctaatcccctcctccagccaccaaaacttaaaggccaggtgtggtggctcctatctgaaatctcagaactttaggagacagcagcaggaggatcacttgaggccaggaatttgagacgagcctgggcaacatagctagacaccatctgtactaaaaattagctgggcatggtggtatacctgtagtaccagctactaaggaggctgaggtaggaggatcacttgaacccaggaggtggaagctacagtgagctataaccacagcactgaactccagcctgagcaacagagtgagaccctgcctcaaaacaatttcaaaaataaataaataaaaacaaaacttagataccacgtggtcaccccaacatgcaaaatcaagttttcccctactgagaagaatggggacttgagagctgagttacagagagataatctgtcttttttttttttttttttttttttggtttacatcctcaagatcatgacctgtgaaatttgaatctaatacacaaatcattccagagcaatgttgcttctgcctaccacgagtaattcacttggccactggaagtcagaacaagcttcccagaagagaggtaccacttggactaccaatataaaaggatgaaaatatcggagtgaaggtgttccttgcatcactgagtccctggacagcctgtccactcatgctgatatctgagcctaatgcttctctgaatgttgagatttaactttgatccaatgaaaccagaccaagaaagaagaaacgtctttcattgttgataaggacatgatttttctcacaattttatgattatttttccttagctgtcctataattatctgcttatttgtctcttctccatgtgcttagggtacaaagttgaccaagaccaagaataatgtctgggagcacaatactgacagcacagctttaaaaacatgatgaatgctttaatacaggaaatgagtaggggagaggcaagtgttgcttgggtgttcttccaatgcatagtatcttccttgacacagtcagtgcagctctcagtaggcaagtccctacatgttagaagatgttactttctgtggaattaagtggcagaacatgccttcaattattttcctttgcagaacaacaccaatttcattagttaggacagagtgctggctgcatttgaattccaagcaacgattagtctatcactgttggtatagattccaaccagtcacaccacctcctgaagtttgtagggcaggtaaatcttcatcttagaataaaaatcatcttagccaagtaagtgttttagaggaaagaagaaaacataatcgtttccataagagttttgtttctaaaaaaataagaaaggctctttgtttaggtgagctaatgaagttgttgatagttatcagatgacactggaatctttacttgtcagaatgtgttctgtgcacctctcggtgtggcaacatagagagggagatcctccagcaatgccattgatatggtcagaaactgcatctttctttctccctgctgagatggagtcctttgttctagaaaacccagggggtgccactgggagtaacccttgagacaggaacacgaatctcaaccaatttctggttgcagccttgagtcttactatttgccatagtgatgcttagcaaggaatggcaggtgcaccagagcagcagaggacctaatatctcccttcctgttaactttttataatattttattgtgatcagtatcagttgggaagctacttgcagtcactgagcctcagtttctacatctgtaaactggggatagtagcatggccctatttaatgtgctcagcgaagccactgaaaggagacagaaatgtaccagaattccctggacttttatcctacttctcctggggattgtcacccacctacccgtgtctgtcctttgttgctttgacgctgtcacttcttttcttaggtacctctctgtagggctccattattccagggattccagagttacagcacatgcatacctccatccaagcatgtttatttgtctcctgcttcactaggctgtccccaaggaacatgtggctcccggcacatacctggcacaacactgcacatgacattcacccacttggccttgaatctgacaaggaatctggcatgatgttcacctgctgaggccaggtgccgagcagccctggaggcttaggggccagagggatgggaaaaggtgtctttctggggtgagtatcagtttctgcaggagtgctgaacctgagaaagaataaagagagaaggaagtgaacaagcacagcttaaacatcatctgtttctactgagttttaacaactctgagattttgtttgtcatggaatccatttctcaggccaagcagacacagaacttgggtgtgagtgatgataatgagctgatataattttcacaccctcatcactgagatctctcccatcaggaatgggtcacagggctcacaggtggcagcaactgttattacaggcctcatctctaccagctcctggcacctgctctcctcccattagaaaatcctccacttgtcaaaaaggaagccatttgctttgaattccaattccaccctcaagaggctgggaccacctcattggagtccttgatgctgtgtgacctgcagtgaccactgccccattgttgctggctgaggtggtttgggtcaacctggccatctgggcagctgttctcttctcttctttctcccctactgtttccagacatgcagtatttccagagagaaggggccactctttggcaaagaacctgtctaactttctatctacggcaggacttttgaaagctacagaggaagaagcacaaattgatgctattccactaagccatcagctccatctcatccatgccatgtctcttttttaggggtcctcttgccaacagaatcacagaggacaaatctgaaagtgcagagacagcagctgaggcacagccaagagctctggctgtattaatgacctaagaagatggagtggtcaccagaaagtcagaggaagtgacacacaggggcccagcaatctcagccaagtcaactccaccagcctttctggtccccactgtgtgtacagcaccctgatagggaccagagccatgagagtgagtaagaccagactatgcccttgaggagctcacctctgctaagggaaacaggcctggaaacacacaatggtggtaaagaggaaagaagacaatagaactgcatgaaggggatggaaagtgcccaggggaggaaatggttacttctgtgtgagggggttggtgaggaaagactctaagagaaggctctgtctggctgggtatgaaaggatgtgtaggagtcttctagggggcacaggcacactccaggcataggtaaagatctgtaggcatggcttgttgggatgagtttcaagtattctggaatgaggacagccatagagacaagaggagagttaatagattttatgccaatggctccacttgagtttgtgataagaacccagaacccttggactccccagtaacattgattgagttgtgtatgattctacatagaatattaactcaatggaggtcagtgagtggtgtgtgtgtgattatttgccaactgccgaggtggagaagcctcttccgactgcaggcagagcacgggggccctgctactggctgcagctccagccctgcctccttctccagcatataaacaatccaacagcctcactgaatcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctgtgagtaactgttcaggctcctcttctctgtttccttggacttggggtgctaatcaggcctctctttcccttatctgttttgaatagcaaaaaggatgttcaggctggccgtggtggctcacacctgtcatcccagaactttgggatgctgagcaggtggactgcctgaggtcaggagttcaagaccagcctggctaatatggtgaaaccccatctctactaaaattacaaaaattagctgggcatggtagtgcataactgtagtcccagctacttgggtggctgaggcaggagaattgcttgaacctgggaggcggaggttgcagtgaactgagatcatgccactgcactccagcctgggtaacagagtgagattccatctcaaaaaaaaaaaaagagaaaaaaaagaaaaaaaaagattttcaaggagaagtagcttaagtgttggatgctacaaacatatagaggttatgatggatgttttgcagatctataaaggaataaataagcatctcccccattcatctttagtggaaagaagggtttagggacagcattgattgaggataatctaatagacaatggtttgtacccagcttaccaaaccagaatttggattttacatttttccctttaagttgcaggagaagagggtgaatcttctcaccagtgagatcctggcatcctagagcaggtggagagaagagtcactccctactgtgtgtactggaggcttcccgcctgtcacattttacttctaactcaatttcacagttattaagagtaaggaatcatggtcacatggaaacagaaaatacaaacctcgttttaattctttcacagaaaagttagcaattcagtgagttgtggtaacatagtttccatctactggcaatttaacatgaattggtgtggcttaaattcatcctttttaaagccagatttttttggagatagactatttccagcatgttccttctgagtgataaaagagggctattagttcagtatttgtgacaataaatgtgtataagataacctcacctttccagaataatgtcaggaatatgagtctaatgtacaaatatatatctctaggacaagactgcatatgtctttttaaaaatactttcccaagagtttattttaatacccccatttcaaatacacctgcttagcaggttatcctaaactctcagggctagaaagtaagcaagactgtgagccagtgatgatagcaaaagcatccaggtaggatcaagatgaagtgagaaaatattccttacccctcagggtagaactccaaatagatattcatgggtcctggccccctagtggaggtcacttgaaggacaaacatgttggcatctcatctgcttgaagcctggacacaagggcaccatcagtgtcactctgtgtgtggctggccatgttgtggggctgtcactacagattctggcagtcaggcagacaataccttagccttagacgatgccggtacagcccaggattcagaagctatagtgtagaccatgcccttcttaggcctatacaattacatgcaatagatgatggatttttctgttagcctcttcattgtaacaaaaagcagcattactctaccaaacagaggggagctggaaagaaactaaacagtttgccaagcacagcctctgccttgacgtggaatcatgtgaatctagacactcacctagatctttcctcgggggccaatgctgctcacacattaactcaatagtttgtcctggcctgagagatcatgtaacatgtagaaagtttagaagcagagattagtgccattgattttccatggctgtgacaacaaaggaaggaacaggagtgggaaaacccaaggccaccctggttgtggtagatggtgcacacacttccactaactattctggggcaaggatccaaatgcactattgggcctggctatgctgtctctgctgggttctccaaacacgagcctccatgctgtttcttagttgtattttaccacatattatcagagtcactggatttgtacagaatgtttggaacctatactgccttaatggctaccctttaaagaagagaaaacaaggtcttaattcaactatctggaacattttatggttacttatgtggaatactccatcttttgctatcaacaggaaggtacctggccattagaaggtgcctgcctttcagctgaaagcacatatgaggcatatggatccatttatacacaccgtacttttgaaccacattttcctaatttgcctgtctggggccaagcttgtgggactagcagattcatggttgaattgatggctggctacctcttccatcaacttttctgcttcatccagtcttccacccctcagtaacctcaaactgggaaggtcttcagatatccagaatccccagttggggaagtccatacatggcccatcaaagatgggttgcaagcaggcctgctatagggagcagcagccttgatgggttttcctacagagacagttgatgtgcagacgcaataaactgactgctttgtaattgatcaccttgaaaaaaaatgagcatgtctggctgtattagtcttttcttccattgctataaaaaaaaatctcagggtgggtaatttagaaaggaaagagatttaattggctcatggttctgcaggctctacaggaagcatagcgacttctgccgctagggtgccctcaggaaatttacaatcatggcagaaggtgaaaaagaagcaggcagatcttacatgactggagcagaagcaagagagggtggggaggaggtgccacacacttataaaccaccagatctcataaaaactcattgtcaagaggacagcacccaagggggatggtgtgaaaccatgagaaactgcctctaagatacaaccaccatctatcaggccccacttccagaattggggattacatttcaacatgagatttgggtaggggcacagattcagatcatatcactggcactgtgcttatcaggtggatatcaccagttggaaggctagattccacaagaggaggaatgtccttgttcttagttgtgattcttctgcacagtgtcattcaggaaaatatgagtcaatcatcctccccaatagctcaaatcaatcagatcctctgaccacagagactgaggtgtagctaaaaggtgctcgcacttctacgaggccaatggaagcctggagcacagttgtcaatctgtagaaataaggactctgtgactcctccaagacctctctgtgaatgacagtttaagaagggccagatcctaaaacagggtcagagcttagagtgaagggaaagcttaaaagcctctgagcaaattctaaagacagggtcaccataggctctcagtgaccccctgtgactgagtggatgcagtgatgcaaaatctcatcatcactgcagaagacaaaagaaaaattgtcactctttctacctaggatgagaatcccaaaatcagggaagagtccacttactaaaaagacatgagggaatgaagtgcctggaagaattcgttcctgaacctctcaggatcattcacatttgagaacatttatcaaatattcatcccagactggggccatgaagacttcagctgcttttagctaatcattgtaactttttggtgtctcatggtggaagcatgaaaggacctgatgaacaaatataatcattgccgtcagagttactgttattttttattgccttaatgttacctcctttgcctgatcattccagttcctcagtcagtgactcaccagcccctatatctataaagtcacaatccctgagacctgatttttgtttcactttgtagatatggaacccgtacacatggactttttaagaagcttggaattccagggcccacacctctgccttttttgggaaatgctttgtccttccgtaaggtgagtgtttttgagcttcctcttttgcttcttatgattgcaaagagcaacttagttccatcagtaaaaatgcttctcctcaagaggaaggtctgagattttatactttcagaaatagcgtgtaggcatcacccagagcgtggcaaagtttaccctggggctctcttgctaactctcaggaacctcaagtttgcctcagttggacagcccaaatgtcaagtagatccagcaatctgatgttcacaacttgatgtgcagactttgtgagcaccataaagagcatttcctttttgctccaggcaggttcccaggaaggtacagccatacttagttagtattaaaagtaggaacaggagcccctgattgtggcttgttatctgtggacatgagagtaaaactttcctctctgtagcaagagctcatgaataggcttttttcccttcctcctgcacagcttggaaactcagtttattagggagatcaagtatttaccattgggtcatttgcacctgcttgaagcctcttcaaaaaatgccaaattttgttggggaatttccatggctttaacccaggtcttactccccatgacatctgttgccactttgagacacagaacaaaagtgttctgctttacttcttttcctttgaaggctgcgtcttgtgggtgagtctgagcagggagtggatgtaactgagatgagatagtggttgtctattaacctcagatatttaagcacaatatgaattcatgggtttattttttacacaaaggcagaatcacatgcaaaatcactagaaaggggatgatttgacaaaattattgaatatttaatttcactaaatagaatgtcatatgtgcctcatggactggggactttggtcgagcctttgtgcctaaccttatctgatgctgtgttcagggcctggtccctggatggaaaattatgagcttatttccacagggccagcagcagcaggagtcagctctctggcttagacaatctgacctgcatacctgaggcttgtttctcagattctagttctcctaagtgagggctttgttgtctaattactgcccaggaatttcatattttttccctctgcaaaagcaataatttccctactttcacatgcgtccgtgtgaggagaccaccaaacaggctttgtgtgagcaataaatgtttttaatcacttgggtgcaggccaactgagtctgaaaaaggagtcagcaaggggagataggggtggggcagttttataggagtggggtaagcagtggaaagttacagttaaaggtggttatccattgtcagcagtggagggggccacaaggtgcatggtggggagatcataagactcattgtgcagagaagaatgtcaccaggttgattgatcaatcagttgggacagggcaggaacaagtcataatggaatgtcgtaagattgctcaatcagttaagacaggagctggctgtttcatttcttttgcagttttcagttgcctcaggccatctggatgtacacgtgcaggcttgggctcagaggcctgacattcctgtctttttatattaagaaaaataaaacaaaatagtggcaaagtgttggggcagcaaaaatttttggggggtggtatggagagataatggatgatgtttctcagggctgcttcaagcgggattatgggccatgtggacaccttaaagaaaattttataatgagttacaaggaataggaatttaggctgtggggagatcttggggcagaggatggtaccatggacttgttaaaagtaatatttgttgtatagaataattggtgatagtctgaatgtgtttttatattaattgagaaaccaattgaagacacaagtcccgaataacagaaggagaaaaacaggtaccagaggactaagaatagggaggagctaagacacccagttagaaagtgtccaggtgggtccaaaataagtatttgcctggctggtgagtttttggtctttatctttaagcttttttatattgtcatataccaggccagattggtttagataaaaacaacattcttcatttaaaaatatagagtactcctttttcagcagtgagtaggtcaaggcctcagcgatgttggaggacgactagggctaagaagtcaacctgggtctgaaggactgataaagtttgtgatgtatctgtaatgctagcagaaaagtcattagaaaggctacagaaagttgtgacagaagttgaaatacctgctattccagctccaagggcaatagtggaagcagaaagtcctaaccctacaagtagagggattagaggaataactcatttttgtctggttggtgtcatgagggggacaggaagttgttcagtcccatttgcaaattgaattttttcaatttgggaataagaaatactagtgtacatgtacctgtccaattagcagatagacatatgtacgtggtggagccacagaggaagcagaggccttgtgtgaggcaaaactggaaatgcaaagtgaaaagatgagagggagtgccaaaagaggtgtcttgcacccagactcttagggatttagtgagggcatcagcccttagtggtcataatggggattgatggggcaactgggtatgagaaagagcatagtgtctacaaccaaactttcattgctattcatggggttcggtataagtaaacaagaagggggaatgggaggagagtctgaagaacaaggggaaggtagccaagaatggagtgaaatacagggcaaatgtcttaagggaaatgagaagttctaggagggggctagttgcttgtaacctacatggaagaggtcatgaaatgacaacagaatagaatgggcctgtgagactggaaggagatatttttcttggtctaagaaccatcttccttgagtggggagggattgatagatggaaacttcagtgggagagtaaataggagtgactgatgagaaggagaaaaactggccatgagggacagaagtaggaatactggttgcttctttagctgtcttatcagcataattgttgccttgagcaatggggtctgaggccctttgatggcctttgcagtgaatgactccagctttttttggaagtaaagtggccttgagaagaatttttattaaagaggcattaatgatggaggacacttgcatagtgaagaaacttctttcagcccatattacagcatggtggtgcaggatatggacagcatttagagtcagtataaatattgatgtgtagtccctttgcaagagtgaggccccaagttaaggcaatgagtttggcttgctgagagatagtggaggggggcagagcagtagcctcaatgatagatgtggaagataatatagcacagcctgcctttgctggtgagtggtgattaggcctggtggaactgccatcaataaactaactgtgattcaggtgaaaaacaggaaagaaggaaatatggggaaatagagtgaatgtcagatggatcagagagatacagtcatggggataaggtgtggtatcaggaataatgtgggaggccagactgaagcccaggccaggtacaatggtaattgtgggagactcaacagagagtgggtattgctaaaggagctggggaacagaaagtatatgcatcaggtgtgaggaaggaaatatattttggaagttatgagaactgtatggagtgagttgagcatagtttgtgattttgagggcttctaaaagtattagggtggtggcagccactgcacagagacatgatgaccagcctaaaacagtaaggtcaagttgtttggacaaaaaggctacagagcacggtcccagtccttgtgtaagaattccagctgcacagccctgcactttggctgtgtgtaatgaaaagagttgggatgagtcaggaagagctagtatgggaacagcctctagagctgtcttcaaggaatggaaagaggagtgaggaaaggatttaggacttatggggtcagctaggtttccctttgtgagtttatataatggttttgttaggatggcaaaaccaggtatccaaaggcaaaagtatccaaccatgcccaggaaggaaaggagttgttttgtagaaggggttggggtttcagagatcagccagacatgatcagcagggagaccccatgtgttttcatgaagaattatgctgaggtacgtaacggatggagaagaaatttgagctttggagggggatacccgatatcctttggagagtaaatgttgaaggagcaggagggtatcttgttgaaaagactcaaaggagggactacagagtagaaggtcatcaatatattgaataatgtgggaagcagagggatgggaagaaagtaaatcatgagagagagcttggctgaagtaatgagggctgtcccagaagccttgtggcagtacagcccaggtaagctgctgggactgatgggtgtcagggtcagtttaggtaaaagcaaagagaggctgggatgtgtggtgcaggggaatagtgaaaaaagcatctttaagatcaagaatggaatagtgagttgtggagggagatattgagaacaaaagagtgtacgggttgggcaccacagggtggataggaaaacaattttgttgataaggcgcagatcctgaacaaacctgtaagacttgtctggtttttagacaggtaagatgggggaattataaggagagtttgtaggctttagaagcccatgctgtagcaggtgagtgataacaggcttcaatctccttaaagcctcttgtgggatgggatactggcgttaagctgggtaagggtgattaggctttaatgggatagtaatgggcatgtgatcagttgccagggagggagtagaggtgtcccatacctgtgggttaaggtggggggatacaagaggaagacacgaaggaggctttgggttgggaagaaggatggcaatgagatgtagctgtagtccaggaatagtcagagaagcagataatttggttaaaatatctcagcctaataagggaactggcaggtggggataactaaaaaggagtgcataaaagaatgttgcccaatttggcaccaaagttggggagttttaagaggtttagaaacctggccgtcaatacccacaacagttatgggggcaagggaagcaggcccttgaaaagaaggtagtgtggagtgggtatcccccctatcgattacacaggggatggacttaccctctgctgtaagagttacctgaagtttggcatccgtgattctccggggggcttccgaggtgatcgggtagcatcagtcttcagccactaagccaaggagatctgggaaggagtcagccaagaaacattgggtttgagctccaggaactttaggagcagtggcgatgtgagtcagacagtccaacctctaattggagcccacacagacagggcacggcttaggaggaatcccaggctgtgggccttctgaggcccagtggccaggcttttggcatttgaagcaaggtccatgaggaggttttgaaggagcccctgggagctgtggcttggatgttctgaaggttttgtatgctggagacatggtcttgggttgtcttacactggaggcaagtagctataattcagagatgcattgtcacttggccgcctcttctctattatgatacaccttgaaggtgaggctatttaagtcctgttgtggggtttgaggcctggaatccaatttttggagattttttctaatgtcaggagaggattgggtcataaaatgcatattaaggataaggcggccttctggcccctctgggtccagggctgtgaagcatctaatggtaggtgctaagtgggccatgaactgggctgggttttcatctttaccttgggtagtttcctttagcttgtcataattaacagccttgtatgctgcttttttgaaccccttgactaggcaggagaccatgtaatctcacctagctatacctggggagtccatcttgtactgccaatggggatgctcttggggaactgccctgatgccttcttgaaggtctggctcatggcactggtgggtgtcagtgtgagattgggctagggtatcaactctttcctgctcatctggggagaggggggaggtcaggatgacatttcagtcactccaggttaaatcgcaggactgagttaaatattggaattcctgtatatatttagtggggtctgatgaaaaagagcctaaacgctgactgatctgggagaggtcgatagagaaaaaggcacatgtaccttgactatgccttcagctccagccacctgactaagagaaaattgttgggcaggtggaggagggctagtctcggaatgaaactgtaaggtggagtgggtgtgaggaggggaggtgatacttctattatagggtgggggagcagaggatgaggaagaattgggacctggcttggcctggtgaggagcagcctggtggggaggggagaggtcagatgggttcatagaaaaggaggattcaaaggactcagagcttagggtggagactgaagaaagagacaggagagaaagaagaaagatttgggatgagtcacactgggagcagagactagggagagactgatgtataaaagaatgcctggatgtcaggcacctcagaccatttgcccatttttcaacaaaaatcatccaggtcttataagatcgagaaatcaaaagtgtcattttctggctatttggaaccattgtccagtttgtattgaggccaagcggtattgcagaagaaaataaggcatttaggttttaggtcaggtgttagtcaaagggggttttaggttttgaagaacacaggctaagggagaagaagagggagtggaggctggaaggttgcccatagtgaagggggcaagcccagagaaaagagaaggtagagacatggagagaggggagatggtacttgccacccagggaaggtggtgcttgccacccagggaaggtggtacttgccacccagggaaggtgatacttgtgacccaggggaggtggtacttgtgccaaggtgaatgatcaaggcaggcatccccacagtgatcagatacctctgaaatgtgggtgaataaccaggcaggtgtcctggcagtgatttagacaccaagggaagactgttcccgagtccatgactggcaccagagttttgagttcatggataaaacgtatctcctccgtctctaccagaaagggaaagaaactgaaattaaggaagggagagattgaagggtggagggatagcaagagaggttggagaagagaataaaaagaggccgcttacccgatttaaaattggtgagatgaccttgggctggctggtctgaggacccaagaggtggatctccccatggagtgagggcgaggacaggggatgggactcccgaaggagtccccctgtcccaggtctttggcaccaaatgtcatttgcgtccatgtgaagagaccaccaaacagtctttgtgtgagcaataaagctttttaatcacctgggtgcaggctgactgagtccgaaaaggagtctgcaaagggagataggggtgggtcagttttataggactggggtaagcagtggaaagttgcagttaaaggaagttatctattgtcagcagaggagggggtcacaaggtgcatggtagggagatcataagactcattgtccagaagaagaatgtcacgaggtcgatcaatcgatcagttggggcagggcagtaacaagtcataatggaacgttgtaaggttggtcaatcagttaagacaggagctggctgtttcacctatttgtagtttttggttgcctcaggccatctggatgtacccatgcaggcttgggctaagaggcctgaaacccaccactttcccatgtcaaatctttagtagatgtacccccaagatacacattcctcggaccttcttttccatagttaaaacttcacccctgaaatgtagaaacaggaaggtttttttttaagtttcagtgcaaactcggagcaagtgtcataattttctgtctccgatgtgtagaggtgacattttctcagaactttcatgttaagctggaaaactggaaagcgagtccactttgtcattctgtcactcactcattttctcactcaacaaacatgcctcacacttatctaaatctgctaggctaaaagaggtccctggtgtctgtaactttctaattctgctagaattctagagtgagctcatgaaataaatgaaaaggatgaagaacaaagagaaaaaagactgcacgttcccttctggcgctcactcacattccctcagcctcagtttctccacatgcccctagaggtgatcattcaaggatttatgagattttagagacaacacatgaaaaagcaaagagacatcagaaagacaaggagttacttagtatttatacacaaggataagacattcagtatcgacaacacttaaagaaaattcaagagtgattttaaatttcccatttcaaatacctcctctattttgtttcctttctcttatgacatctctaaataagcttcctctaactgccagcaagtctaatttcattggatttgactgttttcaaccccaattagaggcagggttaagtacacttaaaataataatgaaatattattttgtttctcctcccagggctattggacgtttgacatggaatgttataaaaagtatagaaaagtctgggggtgagtattctggaagattccattggatagacttgtttctatgatgagtttaccccactgcacagaggatagtctcagcccagagcctcttgcgatgaagctcttgccagcctaactacaaacagagaggttttctgaaagaagaagatatgtatttgggagaagagtattagaatgggaaactgtgtgccattataagctatgtgcaaattcagggaggtaaaggaagacaaagatgttccacagaaaatatgaggaggacttcatgtggattttgaaatagttctccttcactacaaagatcagtaacaagggtgatgccacaccaaggttggacaggcagttgctgggcaggtgtccttgcagaaatatttttgtgtaaggttgggttgggctttctgcaagctggtggttttgccaagtattttgtgatagttttgttatcaggcacacaagcatgagaatccactcatcatagccttctttgatttatttgtcaaggtttttaatcacacacataggcacacagacacactgacacacacacacacacgtgtcataattttggttctcacaatgttcacactcgctattgtaaaacaactttttgagatttgtcctaccaaggatcccatatgtcaccaggtgttgaggtcttcggtctaaactaggctgagaccattgtggttaccacttttctccaagctttggtggcccagggactcccagcatcacgttctgtccagtgtctgcctattcccctcttctttttttcttcccttgatgcccttttatcacatgcattgtctcagacccttcgaatatgtgctcataaatgcatggcatcatctccttcccacatcgattcactttcaattaaaagccaaaactctttcatttcaactttggatttaacatgcttttgaaagaagggttgagaaatatagagaaacagattgggaaaccatgctctgctgtttcttttttttaaactttctatgtaagtgtggaatttttcattctgttttattattaactttaagccaagactttttaatagaaggatatataaatacatctttgtctatacatttctgctgaatttgaagagatgctgaatattcttaaaccattgtgttccctggtgggctgatggactgtgattttataaggtggcctcagccaactgcagcagctgttccctgtcagaggggctagaggtttggcaagagcggtggaagaggtgcagtggtgtgttcgttcactagaagcattagggagaaggttttgcctgtttgtatttcatcttctctcatcaagtcctcagaaaccacagtgctgtctgcagggtgctgtggatctggcatggcccatacaggcaacatgactgagtagaaaggacacacagctctggatgtccttgggccccacagcaactgcccttgaaacatttagtccttgtgagcatttgatgatttacttgccttcaattttccatggacctaatactctttataaagggaaatattttaaacctatgaaacattgtggagaatggcatgggaaatacccatgtatgcaccacccagcttaacaaatgctctcctgtcatttctaaccacaatctctttgaagagctcttttgtctttcaatctctcttccctgtttggcccacattacccttcatcgtatgaagacttggatggctcctgtgtcagactcttgctgtgagttatacctaatgaactagaacttaagattactgtgtattgtacatctagaggattatgtaatgtccggatcaaagtctggcttcctgggtttggctccagctgtagcataaggctgttgatgtttaatcaactctgttttctccacacagtatttatgactgtcaacagcctatgctggctatcacagatcccgacatgatcaaaacagtgctagtgaaagaatgttattctgtcttcacaaaccggagggtaagcatccattttttgaaattaaaatactcattgattgattaaatttttattttaaaattcttatatattcatagacagttgcctaaaaactgtgcaggaaggttccatgtacacttcatcctgcccatcccccatggtaacatcttgcaatcttgcataactataaatacagtatattcacattactgcagtacaggaaattaacattgatacagttcacagagtttattcagatttcaccagttttatgtgccctcatttgtgtgggtagttttttgtttttgtttttgtttgttgtttgttgtttgtttttcggactgagtcacactctgtcacccaaatgggagtacagtggtgtggtcttggctcactgcaacctccacctccagggttcaagtgattcttctgcctccacctcccgagtagctgggactacaagttgcaccaccacgccctactaatttttgtatttttagtagagacgaggtttcaccttattggccaggctggtcttgagtgtgtgggtagttctatgcaaatttatcacatttgtagatttgtgcaatgaccagcatgatcaagatgcagacccattccatctccgtatggctccctgctactatcctacagtcacgagtgtttttctctgagagggtctttatcagggaaaactttttttattttgaggaggccaatgtattaatatttttttatggattgtgcttttggtgtcaagtctgaaagttctttgcctagccctccttcctatattgccaatttttctaaaagtcataaagtttaatgctttactaaatgtaactctactatctattttgtgttattttttgtataaggtatgagatttagatcaacgttcattttttgtggcttgtagttgtccagttgttccaaagccatttttggaaatgtgggcatattgttaaaaattaattgggcatgtttctttgcatctttcatttgctattctgtcccattgatcactgtgtttattcctccatcaacaacaaactggtgactctaatacctgtacagtaactcttagcatcatgtagagtgattcttcccacttttatggatgtatttttttagatttgttttagctcttcctggtcctctgcttttccataaaaattcagaatgagtctctcagtgtctataaataaacatgctgttattttaacaagaattgaattaaatgtatagatcaatttagggaaagtctttatcttcactatgtttggtctttcaattcatgaacatagtatgcctctccatttccttagattttctctgattgcttttagcaatttgtagttttcagcatagagatcctgtgcatgttttgttggatttacagctaaagtatttcatttttgttggagtgattgtaaatgatattatgtttttcttgtattttcagatattgattgttggtacatagaaacatgcttggcttttgtttgttgatcttgtatcatagaaccttgccgagctgacttagtatttctagaagtctttttgtatattcttgagattttatacattgacaattatgtcacttgaaaatagagacaattcttttatttcctttccaatctgtatgccttttaattctttttcccagtataatgtcaaataaatgtgttgaatttttgaattgttcctaatattaggaaggaagcatttggtctttcatcatcaagaatgatttagatgaagtgggtttttttgtagattctctttatcaaatggaggaattttctctccctagtttgctgaatttttaacataaaagagtactgtaagtactcattataaaacaaaatatggctgtggaagatgaaagagagtttcaagcatgctggcttgataggccagatccaagctggcaaaaataattatctctttcttctttttttctatccatggaataaaaaattaagaggaaagaatgttaatagaatcgcattatttcttcaaaatacgttgtgagttttaaaagtattacctaccttttttattatactttttttagggtacatgtgcacaacgtgcaggtttgttacatatgtatgcatgtgccatgttggtgtgctgtactcattaactcatcatttaacattaggtataactcctaatgctatccttcccccctctccccaccccacaacaggccccagtgtgtgatgttccccttcctgtgtccatgtgttctcattgtatatttttttaaatctaccacatcaaggcacctctttttcatgttgcccatggtttaggtgaacataaagacagagctcgtctgaggcaacatacagtccaacaaagccacctgcctctctgtctccactctctctctacactgcacgcgtgctaggtgttgatcctgtctattccagtggaagaacaggttccgtaccatgtggagaatttgcatgtaaaaggagactgggatatacaggctggagaccacatcaggtggctgggcatgtgggataaatcctattgagcatctgtcatagggcctgtcacttagtagacagtcactaaatatttgttaaatacatgatgcctgtttaacacattttctacaaccatggagacctccacaactgatgtaggacaaaatctttctgctttgaactctagcctttcgggccagtgggatttatgaaaaatgccatctctatagctgaggatgaagaatggaagagaatacgatcattgctgtctccaacattcaccagcggaaaactcaaggaggtatgaaaataacttgggttttaattagaaacttaaagaatgaatcaggtggggacaggtagaaagtaagatcagagttcctttccgaggagtagtctgctgaatttgagcttcctaaaaatagtctttttatgtacagaaaacacatcataaaattcattatacaatgtcacttattgttccatgccaggcaaagtcatgtccttctgggacttatgtctgcacatttaactatgggtggtgttgtgttttgtgcttagatggtccctatcattgcccagtatggagatgtgttggtgagaaatctgaggcgggaagcagagacaggcaagcctgtcaccttgaaacagtaagtaggagcacagccatggggttctgagctgtcatgagcccctccagctgcctgctatggagctgatactcccgctgttgggttattccagtgaccagacaaaaggagggctgtggtaatgcaacttcaatgggtctcccaagatggggcagctccgatgaggaggtggggcagctggaggaaaaggatcttctcccctgtgcacagaggtcagggtttacatatctgttaaattgtcaccttggatattctggaggactaaatacatcctttagggggaaaagtgtgattgtatcaaagttttaagcatggagtgtatgggatggtggaaggggaaggcacttggtatctgttggttggcagtgagtagggtgggaaagttataatggagaacttagaataactttgatcatttcatgttttttttctgagggtatcagtagaatactaaatattaaacattcccaccatttctttttcctccagtctcaaagagagagggtggtaaaaacgctataggtggggcaagcctattatttgctgtctacacttatgcaggaacaacaggtgtaatctgagcctgtcctgggcagacaggggatatgtggtcactcactatagaagtttccaaatcaaattttgagagttttttttaaccaggacatcatttgtcattatattttacaaaaataattctgccatcagggcaacctcagctcaccacagctggggatagtggaattttccaaagcttgagcagggagtatagagaataaggatgatatttctaggagctcaggacatggtactgttgctttgtaaagtgctgaagaggaatcggctctgggcatagagtctgtagtcaggcaatgtcacctgtcttgagccccttagaaagagtgaatttttctactcttgttctgctgaagcacagtgcttacccatcttgtatcatccacaattaacacatgctactgcagttgtctgatagtggatctctgtctttctatgactaggctccttgacctcagaggtaagtctaactcagttgagtgtctccatcacccccagcggagagccagctgtgtcactgacacctgataatcaccttctgagggagtgtgatgggagatgctccagtaaatagttctgaaagtctgtggctgtttgtctgtcttgactggacatgtggatttcctgctgcacgcatagaggaaggatggtaaagaggtgctgattttaattttccacatctttctccactcagcgtctttggggcctacagcatggatgtgatcactagcacatcatttggagtgagcatcgactctctcaacaatccacaagacccctttgtggaaaacaccaagaagcttttaagatttaatccattagatccattcgttctctcaataagtatgtggactactatttccttttctctccctctctcttaaaaataactgctttattgagatgtaaatcaccatgtaattcatccacttaaaatgtacagtttaatggtttgtagtacatttgaagatatgtacgaccatcaccattgtaaactttaaaacacttctgtcattctagaaacctcatacatgtttagctatcaaccccctgccagaaatcctgttgtcgtatataaccactagtcaactttctgcatctatagatttgcctattctggacacttcatagaaatgatattaatttttcagggtttttttaattctctagttcatgaatttgtactttagtctgtattattttctttcttctgctggcttcaggcttagtttgcccttctccgtttactgtgttgtggcatgaatgtagattattgatttgtgggtttttttcctctaaatttagacattacaactataaatttccctctgggcacttgtttgctaaataacatgacattctggcctatcacatcttaatttttgctcagctcaaaacagtttctatttgcccttttaatttctacttcaacttattggttgcttaaaagtttattgtttaacttccacgtatgtgtgagtttcccaattttcgttaccttattgattttagctttatcctatgataggtgacagagatacactgtgttatttctatctgatttcttgaagagcatgattaatttaagcagcaaattatgatttgggttatcctaagagaccctagcccaatacataaaggcaaagagattagggcattgaattttgttcctttcatcattcaaaagatgcagaaggggctgctgatctcactgctgtagtggtggtccctatgcacagaccttcccttgctcagccactggcctggaagaggggcaaaagtcatagaaggaatggcttccagttgagaacactgatgtatttcactcttctgattggtagagaaaattagaattgctccaggtaaattttgtatgttcacaatggtttcgttttctgttggttttttttttctacagaagtctttccattccttaccccaattcttgaagcattaaatatcactgtgtttccaagaaaagttataagttttctaacaaaatctgtaaaacagataaaagaaggtcgcctcaaagagacacaaaaggtaaaacgtggtggtagttataggaggatgtttagttttcataattttttagaaatatacatatgatcggtgcacttccctgtatgtttttagagaaagattttaacataaagagtacttatgtttagagcaagataattcatttggtaggaatgcagaaagtggagtttgaggaaggagatatgagaatgagtcagagagagcacttaaaatttgatatcaggcacaagaattagtatgccatgacataaatattattcagataaaaccttatcacagcacttcccttcaataaattgtcaaaggataaacattactgtttggaaatacattttattggtattatgctttctctagatcatagattggtaaagagtcatttcaagtacaaggctattattttacacattctccaacaaaaggtcctatcaggccacctgctgaagtgtagtgtgtgttacatttgagccctctgacagcctcgagtgaacagaggtcttctctgggaattgaggctgcaaggctggctaactcagctttgccttcatgagccctggagtccagccaaaagatatctgcaggtcaggggggcaagaaggggtaacccaggtgtcactgaagattgtacagatttggggaatgttgcagtatttgaaagtgctcccaccaaagctgctgacaagttctggaaatgtcaggagaataatctttgtggacattggtgatgaagaagacagaagaataaaaggcccaggacttcttcatgggtatgcagttaggaccagggaaaagaccaaaaagcaattgaacattttagccagatttgtttcaggaaaacatcctgctttccaaggatttagatggatattccttttcactggtgactcaggcaacacccatcagatttctggtctccaaggggctatattctcagaagggaggttgaggactgcacttctgattaacttctgacttcacgagtcactttctgtcaataaaatttctctttttgcttctagcaccgagtggatttccttcagctgatgattgactctcagaattcaaaagactctgagacccacaaaggtaacaaaagagtgcttctgagggctactggtggggcactcagagggaaggttttgttctgaaaatgtgcaggaagtattccaggtagatgagaatttctgccacatagcagaatgacacaggtttggatgttaaaatggtagctggaggcaacttctagaggcatgcaggcatagatagccatgttctaagcttaaagggcaaccctaaggaaaactggcatgccaggaagagtcagcagtctgtggatcacctacataagatcaaatgccagttctcagcctcctccagatccacagaattaaagtttcttcctggaaatttattaggtttctgcaaaaataattgcaatttttgtgattgctttcaatggcaaaaaccgcaattacttttgcagcaacttaatgcatctaacacctaatcaggagccatgctatccaaataagggcgattttaactggcaatttttggtgaaagtgtgttcaccaggttaatcaactatgaagttattttttcctttgcaatggataagtaactttttggaaaacctctgagactgtgtaaatatcctttgtcttcagtctttcacctaccagttttacaacccatgtacgatttttactgaagtcattgttactatgagtggcaaaatgatggccatgttcagtttcaagccaccaagatttggcaatcatgtcacaaaattcctgaatatttaatcattggttctagagagcaggagtaggctgactttggcatacagatttaaatatgtccatgtctacatctacttctgtctgtctgtctatctatctatcatctgtccatcaatcatctatttatctacttactgattatctagctatcatctctctatctatcccaatacaacttgctgtgataaaggaaatagcctactgttttagtgtttcatctagaaatcactagacacatatagctattgagcactgcacatgtggctagtgccactgatgaaaaattttaagttgtatttaagtttaattgaataaaatttgattttaaatagccacatgtcaatagtggctaccacattggacagcagagctctaaactttgagattatagtttggtttcacatcagtatcatcaggttcatggtaacagaatacaattattagatagttgaatttacccacaactgcatcacagaaatcttcactggtaaatcacagctctgttgacatttctcacactcctttcgtattggttttggtggtgagttacatggttggaacaggcactatatttatttctgtgttcccggtctctaaatgtcctaatccagtcctgatcaaacagaccagtgatgggccatcctgagcttctctcaggaaaaaaatcaagagaggggccaacttgcaatcacaagagcttataccattttaatgccattcatcagactgcaatcaatcaccactcatctagctttttgtccatcttcagttgctgtacatcctgagatagtcaattctgagacctatagcctgggtctattacctggtgcctctcaaagatataatccatacttctcaacctgggctatgcacacaaattaccacatcttgtgaaattcagacttgaatcagtagttcaatggtggggtttgagattttgcatttctgtttttgttgttgttgttgttgttttgttttgttttgagacagagttttcgctcttgttgcccaggctggagtgcaatggcatgatctcagctcaccacaacctcagcctcccagattcaagcgattattctgcctcagcctcccaagtagctgggattacaggcatgcgtcaccatgcctgggtaattttgtatttttagtagagaaggggtttctccatgttggttaggctggtcttgaactcctgacctcgggtgatccacccaccttggcctcccaaagtgatgggattacaggtgtgtgccaccatgcccagcctttgcatttctaataaggtcacagatgcttatgatccacggaccacactttgagtagcaagaggtggtctgtattccaatattggtctcttaagttccctcaaacatatctaaaggaaaggtcctttaattttccatacatctagccattaatgttgcaaattctctcaaagtttgtcaaggtatattgtagctaaaatgaattacatttttcttgggagagaagactaccccatattaatttacaataaagtacttttaggatcattcaaggagcacaccatgacactgagtatgttatgcagaaatgttctctctggaaattacccagctgtgaaggtggcagggatggcacgaggaggagcggatggtctacgttcttgaagacattgggggaaaactggattaaaatgatttgccttgttctggctctgtaagacacacatcagagtgaaaccacccccagtgagactctgaattgcttttctattttttcccctggggatttgaaggttccacttagatttcttttcatctaaactgtgatgccctacattgacctgatttacctaaaatgtcttttctctcctttcagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggtgagtggacagtacatggagaaggagggaggaggtgaagccttagcaaagatgcttcctcaccacttcccaggagaatttttataaaaagcataatcatgattgtttcattcacaatatgtaggaaggctctcaaaataaaaagaaggaagcatagggaatggttgctattggcagaagtataagatctttgtaaaacagtcctctccctggttcatctgctttctgttaccacaataatgctaagtaaaaaaacatccaaaaacctccctggcatttaacaatatgcatattgctcacacgtcttgatagtgagctctgctgatattggcaggacttgctctggtctggctgtgatctgatggagcctggccctgggtgcgctgtgcaggttgactcagctctgccccacatgtgtctcatgtttcagtcaggtaaccactggtgaagaagcaagctaggaaccagggtatctgacttctgagctaaactcttaaactctataatattgcctttcaaatataacactaagtactaggtgcctatcaaccacactgttttcagacctctgccaaaacttggattctttgtgctatgaagagacatggcttttgggctggtctttgtgtggcagtgaggtgagcacaaagggatgttcttcagagattacagtccagccctgaagcaacaactaggagactgtttcagcaagtgaggacagggctgtgtggggttctatccttttcataactttgcctggcactgaaatcacatgctctgataacatccaccagaactttcttttgtcatatttgggatagaaagggactagtttttcctcaaattattgatagagattttatataatatagtgtttctctccacattttatgtatataacaaaagccctgcttttgtgtatatatgcatatatatatatatacacacacacacacatatatataatacaaatcctgctttgtaactgtttttgtttgtatatataacaaaaagagttatgaaccagaagtttggccaataatccttgtcgcacagagaatttgctttttctatctgttttcacttccttggttacagacgtgtaacctcttttttgaatggtgacaatcactttgtcatattttatttgatgctagtggtcatagcctattagtcatgtttgcttccatgagaaagaaaaaccactacatggttatgctaaggatttcagtcattggggttagagccttcccgaatgtctcctgctttcataactcctccacacatcttagtgggccattgagcacatcaaagggcatgacagttattaaaatactttatgaatgctacaatcctttgccagtatgagttgttctctggaacttctaacagttcaacagtactacatggactgagttaaaagttaattcaaaaatctcaatttatccaaatctgtttctttcttttcaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggagagagcctgagaagttcctccctgaaaggtaggaggcccctgggaagggagccctccctgaaccagcctggttcaagcatattctgcctctctacaggacagtctgggcttgtacaatcgtttgcttgtctttttatgtttaaaaggttttttcaaatcatgaaattgatcattgtcacactttacaaaccacagactagataaaagaaaactatagccagtcacagtcccagcaacttaagatgaaggtcctcaattatgtccttatgggtcataagtgtccaaaatgtaaggactcttttaaaaacacatgatcacaatgctattattatgtcccacaaatgaatattttttcctgaatatactcaaatcttcaggaatcaaatttgaataaaaaacatgcgtctaatcttcaaagaatttataggttagtgcaacagatagacaaagaaagcagtgatgacactgctttccatcaatacagtagcatcatatgcctgtgtaaattatctgacttaaactattctatggaggtgtgggggagaaagaaggagagatggagattagaagaaggaggagaaggaggagagaaggaggggtaagacaaggtagggaggagaaggaggagaattagaaaaacaagagacgagaggagaaggaaagtgcaaaataacaattttgaagtagtgcaagacaatttcttctccttcctcatgaccaacataagggtgacttgaggcaggaatctacttttctgtcagtcattctcatcacttatgtgccttttgtagtgtgaacacatcaccatcctgactataatttgagtgtttagaaataaatatactttgcaacagtatttatctcctctcaacaagactgaaagctcctataatgtaaggagagtagaaaggatctgtaccttacaattctcatagcaaaatatgcatagcaggatttcagtgactagcccacaaaagtatcctgtgtactgctagtagaggggtgggccctaagtaagaaaccctaacatgtaactcttagaggtattatgtctttaacttttaaaatatctaccaatatggaaccaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacaggtcagtcaattttctgcattaataatgttttattaacaattattttaactgaatggtctatatatttaaaaaagaatacactcacttaatcttttaataatttgttctatgggccaaggaatctatttggacccatctatgatctttaagggtgcttcagttctggagttcaaaagctgtagcattaaaaacatcatgcaatgtcaatgtagactagcatgacatgattatctacagtctccttgaacttgagcaaaattaaattcagtttcaagtcaattggaaagatggggaagtattttgcacaatcatgaggtgcacttattatcttgttttgacttttgaatgatgctcttccttcccagaacttgtagaagttttctcatgacagtggctcccaaccactagctgtacattggaatcaccagggagctttaaaaattcatgatgcctggaacatctcagaaattctaaactaatttgcccagagtgtggctttaaaagctcccccattgcttctcatgtgaagccaaggtggaaaatgactaatttaaggtagttctattggatacgaaggactaccacagtccaaggccatccttactgacctcaccttccaggtgcctagctccaaccaactgggctccttttcaactcaattataactctgctaatcttctttcctttcttctcctcattctgttcttatctttcaagtcctagttcaattcccaagcccctccaaggtgtcttcttgacctagtccagggctcatttactcctctgctctgttattagttactggaggctattatcatataatttcataatttgccattaaatcattgagttttgttctctatattttctctttatctaagaatgtcttcccccctccattaacaatatcttctcattttattccatttaaaatatcccagtggtgccttgcaagtgacctcatctaactcaagcatttggtcatttggtaaatgtttaaggagtgatatgcagtcgattggtttgcatacaaatattaagttttttaatgtgaacatttagcaaatgacattcatgtatttgcatgtgtgtgtgcttgcacatgtgcacatgcatgtctgtctgcagggaaaatatattcatgccttttgaaaatttttaaataatgtgttatatttatagaaagatttggaaccttttctctgaagaagttaaagaacagatgtcattgattcatattaagcaagaccctataaatcttatttctaggtctcatgtatttattaagcaactccacaccttaagcaggctttctacatagaagaggaagaagatagagatggtttccatattattttcatattccacattatttgtggctttaggccagctatgtagctatcctgtatgtgtgctcagacaggagactcagccctgagagaaggcggtcctctggcacacctaggatggggaaggtactcccttggaagtcccaagctggcacttctggatctccatggcaattttcttgcccatcactccatggagatcagaatatcactctattgtgtcccctcaacactgaaggagtgtctcaataagaaaagttgagtcaaaacactgtaggaattgagaggttccccacttgcactacccttgtaaaccaagagaagatgttaaaaaataaaacgataatgcttcctgaaggtgtcttcccatctttacactagatgggttcaattgagaggaattactggactgtggaagttgaagactgtccacataattaaaatgtacaatagctactcaggattaccttgcaagtttcaacatacacaaaattaacttcataagatggtttaaaaagtttaccgttatacctaataatctggtttaaatttttaaaactcatccattttcgttaaaatttaaatcaaaaaagaacacgggttcccatgaatttgtctcaggtcaaacctcacacagaataggtgctccatgaatattttgttaaatgatagatgatgaatgttctcactatccaatcttcacacatcttatagagtaagtataacgaatccaagatttatagtgctgaaagtagtttttatatgtttacaaagcattattgtcagtaatttttttttactttgatgctatactttctacttttgctttatttaatgcttctcaatatgctcgtttaactgttgcagatccccctgaaattacgctttggaggacttcttctaacagaaaaacccattgttctaaaggctgagtcaagggatgagaccgtaagtggagcctgatttccctaaggacttctggtttgctcttcaagaaagctgtgccccagaacaccagagacctcaaattactttacaaatagaaccctgaaatgaagacgggcttcatccaatgtgctgcataaataatcggggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaactgaatgactgagaaccaacaactaaatattttgatcattgtaatcactgttggtgtgggaactggagtgcagtggtgcaatcttggctcactgcgagctctgcctcccaggttcacgccattctcctgcctcaacctcctgagtagctgggattacaggtgcctgccaccacgcccggctaatttttctatttttagtacagacggagtttcactgtgttagccaggatgctctcgatctcctgaccttatgatccacctgcctgggcctcccaaagtgctgggattacaggcatgagccacggtgcccagcccaatttgattattaacataggtgagagttaacccactatgactttgcccattgtttagaaagaatattcatagtttaattatgacatttttgatgagacacagtggctcacacctgtaatcccagcactttgggaggccaaggcaggcagatcatctgaggccaggagttcaagaccagcctgaccaacatagtgaagccccctttctactaaaaatacaaaaattagctaggtatggtggcacacgcctgtaatctcagctacccaggaggctgaggcaggggaattgcttgaacctgggaggtggaggctgcagtgagccaagatcatgccactgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattggacaacaaggctgaaactactcatttcttttcttttcctatttcttcctttattttccctttctgaataatttagccctagagccattaggtgggtggcagccagatggtggccacacattaaggtagagaagagagtcatggtggttccaagtcagagaccaagtaggatgaggacaaactgggtgttcatgtggaaacagcctgcctgggtgtgggagtccaagcaagcagagaaggggttcatagagaggtgtggcctacaagagcagccagagcctaaatagagcatggagaacccatgtgaggtcaggagggcatccatgagtgggaagtgatgggtgaggtttggttacataaaggggatttatcaaagaagtaaatatattaaggatgatagaagccaggcttctcatctttgaagaacggagtcatggattcagaaagggagaaaactagcatgaatcctatgaaattagattggaatggatgtattcgtgtatattcatacccttctagatggatagatgggtagataggtgatagataacagatatacgatagatatatagatagatgaaatgtatacatgtgtttgtgtgtgtgtacaaaaaaaaccatatatttcctacttctcttcactgataggtctaggtaacaatgacatttcaatagcaatgagcacacttagcgcccaagtcttggcttatgaataccatattccatggaaaggaaccagagctctttagagaaatgcctgattccagggccagggttaagaaggttcaagacaagcctaggacacattttgtgccaggaagcaagaaaatgttcaaatgatttccaagtaatgtttggaaatgatatttgaaaaagaccctccaaatgataactccaaattattttcaaatgatatttgcaaaaacctaaagactccaccaaggaactactagaactgataaaatattcagtaaagttgcagttgcaggatacaaaatcaacatacaaaaattagtagcatttctatatgccaatagtgaacaatttggcaaaaataaaaaagtaatcccatttacaatagccacaaataaaactaaatacctaagaattaacttaatcaaagaagagagagatctctataatgaatactgtaaaacactgatgaaggaaattgaagaagacacaaaaacagaaggatattccatgtttacatattgtaagaatcaatattgttaaaactgtccacactacccaaagcaatgtacagattcaatgcaatccctcaaaataccaattacattcttcaaagaaatagaggaaaaaattctaacatttctatagaaccacaaaatacccagaatagccaaagctatcttcagcaaaaagaacaaaactggagaaatcttattacctgacttcaaattatactacaggggtataataaccaaaacagtatggtgtttgtataaaaacagacacattgaccaatgaaatagaatagagcacccagaaacaagtccacacacctggagtgaactcatttttgacaatgttttcaagaacatacactggggaaaagacggtctcctctggtgctgggaaagctggatatcaatatgcagaagaatgaaactagacccctatatctcaccagacacaaaaatcaaatcaaggtggatgaaagactgaaatctggccaaacacggtggctcatgcctgtgatcccagcactttgagaggctgaggcagacagatcacttgaggtcaggagttcaagaccagcctggccaataaggtgaaaccctatctctaccaaaaaatacaaaagttagctgggcatggtggtgcatgcctgtagtcccagctactcaggaggctgaggtgggagaatcacttggacccatgaggcataggtggcagtgagccaagatcataccaatgcatgccagcctgggcaacagagtaagactctggttccaaaaaaaaaaaaaaagactgaaatctaagatctcaaatgatgaaactgctacaggaaacattgtggaaactcttcaggacattggtctgaacaaaaaatgctgaagtaataccccacaagcacaggcaaccaatgcaaaaatggacaaatggaatcacatcaagttaaaaagtttctgtgctgcaaagaaagcaatcaacaaagtgaagacgcaaaccacagaatgggagaaaatattttcaaacactctgacaacagattaacatccagaatatacacagagcacaaacaactctttggaaaaaattcaataatcctaataatcaaaaaatgggcaaaatatttatacagacatttctcaaaagaagaaatacaaatgccacatagttatatgaaaatgtgctcaacatcattgatcatcagagaaatgcaaatcaaaactacaatgtcatctctccccagctaaaatggttttaatccaaaagacaggcaataacaaatgccagtgagaatgtggagaaaagggaattctcgtacactgttggtgtaaattattacaaccactatagagaacagtttggaggttcctcaaaacattaaaatggacctatcataagatccagaaatcccggtgctgggtataaaccaggaagaaaggaaatccatatattgaagagatatcttcattcccatgttcccaatagctgctattcacaaatgccaagatttggaagcaacctacatgtccatcaacagatgaatgggtaaagagagtacttcacttatgcacaatggagtacaattcagccatgaaaaaagcatgagatcctgtcctttataataacgtggctggaactgcaggtcattatgttaggtaaaataagccaggcacacaaagacagacattgcatgttctcacttatttgtgggatctacaaatcaaaacaattgagctaatgtctgggtcttagtcaattttgtaccctaagtacagggagcacagccattagaatacatgatgaatgctttaatacaggaatgaataggtgagaggcacagggtggttgggtgttcttctgatacatagtatcttccttgacacattcagtacaactctcaacaggtaagtctcttcatgtatgttaccttctgaggaattaagtggcagaacatgccttctattattttcctttgcagaacaagaccaattgcattagttgggaaacagtgctggctgcatctgagccccaagcaaccattagtctattgctatcaccacagactcagaggggatgacacacaggggcccagcaatctcacccaagtcaactccaccaacatttctggtcacccaccatgtgtacagtaccctgctagggtccagggtcatgaaagtaaataataccagactgtgcccttgaggaactcacctctgctaagggaaacaggcacagaaacccacaagggtggtagagaggaaataggacaataggactgtgtgagggggataggaggcacccagaggaggaaatggttacatctgtgtgaggaggttggtaaggaaagactttaacagaaggggtctgtctggctgggcgtgcaaggatgtgtaggagtcatctagggggcacaagtacactccaggcagagggaattgcatgggtaaagatctgcagttgtggcttgtggggatggatttcaagtattctggaatgaagacagccatggaaacaagggcaggtgagaggatatttaagaggcttcatgccaatggctccacttcagtttctgataagaactcaggttccgtggactccctgataaaactgattaagttgtttatgattccccatagaatatgaactcaaaggaggtaagcaaaggggtgtgtgcgattctttgctactggctgcagctgcagccccgcctccttctccagcacataaacatttcagcagcttgacctaagactgctgtgcagggcagggatgctccaggcagacagcccagcaaacaacagcacacagctgaaagtaagactcagaggagacagttgaagaaggcaagtggcgatggacctcatcccaaatttggcggtggaaacctggcttctcctggctgtcagccttgtgctcctctatctgtcagtaactgtccagattcctctcctctgttaacttggacttggggtgctactcaggcccctgttccctcatctgttttaaagatcaaaagagatgttcaaggaggagtagcttcttggatgctacaaacacatagaggttattattgatcttatgcagatttatgaagaaataaataagcatttgtcccagccaccttctaattttggtgactaggagggtttggggacagcatttgttagtgggaatgatttgattagcttagatttgacctatactaatcaatgaaaatgaaaacccagcaaaggcagattacaaactgctgaacaagacgagaagtgtgatcctcatccccttcccaggttctcgggattctgggggcaggagggagcagcttgggtttttgtctcattaccttcattttctgggttctctgtctgctggaagagatgtgtagaagtttttcctctgtggacctggtggttcctgctcccctaacttccaccccaggatatcatttacataacacaccggggaacaccaagacttcacgggaagctgtcccccggctcttccctctttcctgtgccatgtcccaaaacatcccctccctcctatgactcactcctccaccctgtcatacacagaactatttaccttgcaatgattaatctccagagcaaaggagacttggaggaagttttgaagatttattctttgctttaatctttttcctcccgtctctgggaggctagcattaatatagagctttgtttctcagctaatgggaatctgctagcagcctgaaaaggcaggagctgtgaaagccaatttggattttacacattttttcccctttgtgttacagtaaaggaggatgaaccctctcactggtgggattcctggcatcctagagcaggtggagagaagagttactttccactgtggttagtggaggctccacctgtcccattaacttctacctcaatttgacttttaagagcaggcaacaacaatgacatgaaaataggaaatataaacttcattttaattttttcacagaaagcttaggaattcagtgagttgtggcaacatggtttccattgtctaacattttaaaatgaattgatatggtttaaattcattcatttttaaatcagaattttttggagatggaatatttccagcatgttccttctggatgatgaaagagggctgttagttcagtatttgtgacaataaatgtgtgtaaaataacatcacctctccagaataatgtcaggaatatgagtctaaagcatgaatgtatatcgctaagacaagactgcgatatacatatttatgtatatctttttatatttaaaaagatatgtctttttaaatatacatgcctgacagtttattttaatacctcctttttgaatatacctgcttagcaggttatcttaaactgtcaggcaggggagtaagcaatactgtgagctagtgatgatagcaaaggcatccacgtaggatccgtatgaagtaagaaaatattcctcagctctcagggtagaactccaaagagatattcatgggtcctggccccacagtggaggtcactcaaaaggcaaacaggttggcatctcatctgcttcaagcctggacacagggacatcaaatgtgtcactgtgtgcgtggtctgccatgttgtggggcggtcactacagactcgggcagccaggcagacaatgccttagccttagacaatgctggtgcagcccaggagtcagaaactgtagtgtagaccatgccctccttaggccaacacaattacgtgcaatagatgactggcttttctgttagcctcttcattggaaccaaaagtggtattactctaccagaggggagctagaaagaaactaaacagtttgcccagcacagcctctgccttgacatggaaccatgtgagtctagacactcacctagatctttccttgggggacagtgctgctgacagattaactcaatagtttgtcctgacctgagagatcacgtaacttctagaaagtgtagaagcagagattagtgtcattgatttgccatagctgtgacaataaaagaaggaacaggagtagaaaacccaaggccaccctggtttcagtagatggtgcacacatttccactaactattctggggcaaggatccaaatgcactatatgctgcctctgctgggatctccaaacacgaccctccatgccatttctcagttgtattttaccacatattatcagagtcactggatttgtacagaatgtttggaacctatactgccttaagtgctacccattatagaagagaaaacaaggtcttcattcaactgtctggaacattttatgtttacttatgtggaatactgtaccttttgctatcaacaggaaggtacctggacattagaaggtgcctgtctttcagctgaaagcacacatgacgcatatggatccatttatatacaccatacttttcagccacattttcctaatttgcctctctgggaccaaccttgtgggactagcagattcacggttgagttgatggctggtgatgtctgccatcagcctttcttcttcctccagtcttccacccctcagtaacatcagactgggaaggtcttcagatatccagaaccctcagttgggggagtccatacatgacccatcaaagatgagttgcaagcaggcctgccatagggagcagcagccttaatgggttttcctacagagatacttgatgtgcagaggcaataaactgactgctttgtgattgatcaccttgaaaaaagtgagcatatctgggtgtattagtcctttcctacatcgctgtaaagaaatacctgaggctgggtaatttataaataaaagagatttaattggctcatggttctacaggccctacaggaagcatagcgacttctgcctctagggagccctcaggaaatgttcaatcatggcagagggtgaaggagaagtaggcagatattacatggctggagcagaagcaagagagggtggggaggaggtgccacacacttataagccaccacatctcataaaaactcattgtcacgaggaaacacccaaagggggttggtgtgaaaccaggagaaactgcccctaagatacaatcgccttccatcaggccccaccaccagcattggggattacatttccacatgagatttgcgtaggggcagattcagaccatatcactggcagtgtgcttattatcaggtgaataccaccagttggaaggctagattccacaagaggaggaatgtcctggaaattggttttttaagttgtggatcttctgcacactgtcattcagggaaatatgagttaatcatcctccccaatagcgcaaatcaaccagatcatctggccacagagactgaggtgtagctgaaaggtgcttgcatttctacgaggccaatggaagccttcagcacagttgtcaatctgtagaaataaggactctgtgactcctctgacacccctctatgaatgacagtttaagaagggccagatcctaaaatagggtcagagcttagagggaaaggaaagtataaaagactcttcacaaattctaaagacatggtcaccataggctctcagtgaccctctgtgactgagtggatgcagtgatgcaaaatctcatcatcactgcagaagagaaaaaaaaaaaaagtcaccctttctgcctaggatgagaatccccaaatcagggaagagtccacttactaaatagacataaggaaatgaagtgccctggaagaattccttcctgaacctctgaggagcactcacgtttgaggacatttatcaagtattcattccaggattgggaccataaagacttctgctgctttcgactaatcattgtgactttttggtgtctcatggtggagacgggaaaggacttgatgtacaaatataatcattgctgtcagagttactgttatcatttattgccttaatgttacctccttctcttgagcattccagttcctcagtcagtgacttaccagcccccatatctataaagtcacaatccctgagacctgatttctgattcagtttgtagatatggagcccattcacatggactttttaagaagcttggcattccagggcccacacctctgctttttttgggaactactttgtcctaccatcaggtgagtgtttttgagctcactctttggcttcttatgattggagagagcagcttagttccatcagtaaaactgcttctcctcaggaggaaggtctgaggttttacactttcagaaacagtgtataggcatcatccaga

SEQ ID NO: 24 - DNA, 2764 bp, Homo sapiens
  CDS (105)..(1616)
  polyA_signal (2743)..(2748)
  polyA_site (2764)..(2764)
cactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacatggctcacgcctgtaatcctagcagtttgggaggctgagccgggtggatcgcctgaggtcaggagttcaagacaagcctggcctacatggtgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcttccatcctcaacacccaactgtctcgatgcaatgaacacttaataaaaaacagtcgattggtc

SEQ ID NO: 25 - protein, 503 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 26 - DNA, 24 bp, Artificial Sequence
  HALB1F primer
atgaagtgggtaacctttatttcc

SEQ ID NO: 27 - DNA, 27 bp, Artificial Sequence
  HALB3R primer
ttataagcctaaggcagcttgacttgc

SEQ ID NO: 28 - DNA, 30 bp, Artificial Sequence
  HALB5F primer
ccttaggcttataacatcacatttaaaagc

SEQ ID NO: 29 - DNA, 20 bp, Artificial Sequence
  HALB4R primer
aacttagaagagtattaatg

SEQ ID NO: 30 - DNA, 32 bp, Artificial Sequence
  Forward primer nt 1-32 of SEQ ID NO: 7
aagcttgaaaacaggactgccttagaagtaac

SEQ ID NO: 31 - DNA, 31 bp, Artificial Sequence
  Reverse primer corresponding to the reverse complement of nt 2035 -2065 from SEQ ID NO: 7
gtggggttgataggaaaggtgatctgtgtgc

SEQ ID NO: 32 - DNA, 32 bp, Artificial Sequence
  Forward primer: nt 1973-2002 of SEQ ID NO: 5
tttaaacatttgacttcttgtctctgtgctgc

SEQ ID NO: 33 - DNA, 29 bp, Artificial Sequence
  Reverse primer: the reverse complement of nt 1-29 of SEQ ID NO: 8
gtgtctagaggtccagacatgtttgctaa

SEQ ID NO: 34 - DNA, 15295 bp, Mus musculus
gtgtgtgagtatgtatgtgtgtttgagtgtgtgtgtgtgtgtgtgtgtgagtgtgtgtgttgttgttgttcccttctagatgacgagcacaggaccatactttccaaacaacaaatcatctcagctactcttcatttttaaagtcctcccacaagcacgagaaaacactcaaagatcacttgagctattttctctttattcagaaactaaacctttagtttaacttttgcatttatgctcctgccaaactcttttgatgactgactaaccatcgagtttaaaagcttgaaaaacaggatgtctagaagtaactaataattatgtggcttcattcctctcagtatagagtctacatataggacgagtgccaggagtttcagaaggaagagtataaattcttactcaccagatgcaactgctcaagtgtttctcttcagttgaaatgatctgtgagcacggagactgtgtcaagaattaagcactttaattctcggctgctaaagattaattagaacatgcccgagtaaggcattgagttagtactgctaaggagaggctcagttgttattaatttatgtcttaaaagtattggagcttcatcagtcactaaaccagctcaagcgcctacttcattctgatgcttttctctccaggctttggctgcatagatgatttttttttttttttttacttaattgtcaaacaaaagtatatatagtatacatagtacatgtgagagtgctaaaagcctgagttaataacacaatattatacttaaacacaatattacatataactatatagtacttgtgagttaataatacaaatacattcaatgacttaagcattacatacttgtttatgtttatcaagacccacaccaggacaggactaggcatgactactgtcttcaaataaatagtgactactctttctaggaagtttaaagaggaattgatccaagaaagaattatctcttctgtttagtttctttttttcttttccaggatggggttttggcttaattctgccacccaccctcaccctcagtagaagttattccatgggcagactttatctatctatctatctatctatctatctatctatctatctatctatctatctatctatctatctacctacctacctccctatccatctatcatctatctatctatctatctatctatctatctatctatctatctatctatcatctatctatctatctatcattctgttcatctgtgtagaggctagtctgttattccatttcaggactcttttgagtgataaaacaagcaaggaaacacttttcccttctccttcattttgccttgactcctgtggttgattacagaatttgtacacctttctgaagatgaggacacaagatgaggtcataagacatagatttctttcattgtataaccagatataaagaagaatgcttctcctcctcctcctcttcctcctcctcctctcttcctccttttccttcttctcctccttcctcttctccttcttgtcactgaatagtccctgtatatttaggaaccatggggttgatttggatgtagtcttgactgactcataagtgagataactggtctgctactaattattatcctgtggtgttagaggaagtatgttacgatggcaaagaccatcatcactgtcattggagtgcctgttctagtgtctcctctaaagcaccccgagaaagaggttcatgttagatgaaaacattctactccagacccgtttcacacatagcctgagcatggggtggggacacaagacttctgaaagtcctctgcacttgttttttattgctctggcttcttctcagttcacatttgagacactgtgtgctttatggaagattctaactttaaaaagatgagaaagacttggaagccctataatgagacccacccctccctcatacacattcttcattacctgtacataaaagcatatttgggatgaacaacctatgcaattcagttcttagcttttaaatgtggcatgcttccatgccaaggcccacactgaaatgctcaaatgggagacaaagagattaagctcttatgtaaaatttgctgttttacataactttaatgaatggacaaagtcttgtgcatgggggtgggggtggggttagaggggaacagctccagatggcaaacatacgcaagggatttagtcaaacaactttttggcaaagatggtatgattttgtaatggggtaggaaccaatgaaatgcgaggtaagtatggttaatgatctacagttattggttaaagaagtatattagagcgagtctttctgcacacagatcacctttcctatcaaccccactagcctctggcaaaatgaagtgggtaacctttctcctcctcctcttcgtctccggctctgctttttccaggggtgtgtttcgccgagaagcacgtaagagttttatgttttttcatctctgcttgtatttttctagtaatggaagcctggtattttaaaatagttaaattttcctttagtgctgatttctagattattattactgttgttgttgttattattgtcattatttgcatctgagaacccttaggtggttatattattgatatatttttggtatctttgatgacaataatgggggattttgaaagcttagctttaaatttcttttaattaaaaaaaaatgctaggcagaatgactcaaattacgttggatacagttgaatttattacggtctcatagggcctgcctgctcgaccatgctatactaaaaattaaaagtgtgtgttactaattttataaatggagtttccatttatatttacctttatttcttatttaccattgtcttagtagatatttacaaacatgacagaaacactaaatcttgagtttgaatgcacagatataaacacttaacgggttttaaaaataataatgttggtgaaaaaatataactttgagtgtagcagagaggaaccattgccaccttcagattttcctgtaacgatcgggaactggcatcttcagggagtagcttaggtcagtgaagagaagaacaaaaagcagcatattacagttagttgtcttcatcaatctttaaatatgttgtgtggtttttctctccctgtttccacagacaagagtgagatcgcccatcggtataatgatttgggagaacaacatttcaaaggcctgtaagttataatgctgaaagcccacttaatatttctggtagtattagttaaagttttaaaacacctttttccaccttgagtgtgagaattgtagagcagtgctgtccagtagaaatgtgtgcattgacagaaagactgtggatctgtgctgagcaatgtggcagccagagatcacaaggctatcaagcactttgcacatggcaagtgtaactgagaagcacacattcaaataatagttaattttaattgaatgtatctagccatgtgtggctagtagctcctttcctggagagagaatctggagcccacatctaacttgttaagtctggaatcttattttttatttctggaaaggtctatgaactatagttttgggggcagctcacttactaacttttaatgcaataagatctcatggtatcttgagaacattattttgtctctttgtagtactgaaaccttatacatgtgaagtaaggggtctatacttaagtcacatctccaaccttagtaatgttttaatgtagtaaaaaaatgagtaattaatttatttttagaaggtcaatagtatcatgtattccaaataacagaggtatatggttagaaaagaaacaattcaaaggacttatataatatctagccttgacaatgaataaatttagagagtagtttgcctgtttgcctcatgttcataaatctattgacacatatgtgcatctgcacttcagcatggtagaagtccatattcctttgcttggaaaggcaggtgttcccattacgcctcagagaatagctgacgggaagaggctttctagatagttgtatgaaagatatacaaaatctcgcaggtatacacaggcatgatttgctggttgggagagccacttgcctcatactgaggtttttgtgtctgcttttcagagtcctgattgccttttcccagtatctccagaaatgctcatacgatgagcatgccaaattagtgcaggaagtaacagactttgcaaagacgtgtgttgccgatgagtctgccgccaactgtgacaaatcccttgtgagtaccttctgattttgtggatctactttcctgctttctggaactctgtttcaaagccaatcatgactccatcacttaaggccccgggaacactgtggcagagggcagcagagagattgataaagccagggtgatgggaattttctgtgggactccatttcatagtaattgcagaagctacaatacactcaaaaagtctcaccacatgactgcccaaatgggagcttgacagtgacagtgacagtagatatgccaaagtggatgagggaaagaccacaagagctaaaccctgtaaaaagaactgtaggcaactaaggaatgcagagagaagaagttgccttggaagagcataccaactgcctctccaataccaatggtcatccctaaaacatacgtatgaataacatgcagactaagcaggctacatttaggaatatacatgtatttacataaatgtatatgcatgtaacaacaatgaatgaaaactgaggtcatggatctgaaagagagcaagggggcttacatgagagggtttggagggaggggttggagggagggaggtattattctttagttttacagggaacgtagtaaaaacataggcttctcccaaaggagcagagcccatgaggagctgtgcaaggttccccagcttgattttacctgctcctcaaattcccttgatttgtttttattataatgactttactcctagcttttagtgtcagatagaaaacatggaaggtgacattcctcaaggccattagctctttgcttctctgtgttatccatcatacacaatattgtggcacttgactatcatgaaaattacacagaaattgacaagtccaaggaaagtaagtggtagggggtttctacatgatcttcgtttgcctcgcagtttaaaaacgtaacttacttcattaacaatttttttatacttaaatttattttaagtggtatgtagaaccaaaaaaataatatatagctcaaggtgttatcaatatacatatcatctatgcacatacatacaaggtacatgttttcttcaccaatttttatcagcacatttggttttgatgctgctctttggctatgaagaaagttggggtaccggcaggaatttgacttttctctcttcctcttagcacactctttttggagataagttgtgtgccattccaaacctccgtgaaaactatggtgaactggctgactgctgtacaaaacaagagcccgaaagaaacgaatgtttcctgcaacacaaagatgacaaccccagcctgccaccatttgaaaggccagaggctgaggccatgtgcacctcctttaaggaaaacccaaccacctttatgggacagtgagtacccagacatctacactttatgctaaaaactgggcaatagctccgttagtaacacttatgctgatagtcatgaaaaccccaagcatccaacaccaagtctgggaatgtgttgagatggtgtttaaaaacataatacttgataccacagactatacaatgacagtaaaaagatcaatgatgttttgatattgaaaacaggacctgtgtgaaatatctgagactgagaagttgcaaaatattctgaaggcatttgtgtgcatgtgcgtgtatatgtgtgtgagtatgagtatgtgtgtggtgttcatgttctctggatcaatttcattttagtcatcaacattacatcaccaaaatttacttaccaaaaatgtacacatgatgtgtgaacatttacaaacacacacgcgcacacacacacacacacacacacacacacacacacacacacacacacacacatatctacatatctctctttgctcacttaacaacagacaaagtccatcactcatgggtgaccacactgagtgaaaccggtcaattacaaatcccatgtgtatccaagggtgtgggttgattctaatcatttctgtagtattgttctgtggggaataactgcctgttttcttcttcttctttcccataactcagctatttgcatgaagttgccagaagacatccttatttctatgccccagaacttctttactatgctgagcagtacaatgagattctgacccagtgttgtgcagaggctgacaaggaaagctgcctgaccccgaaggtaaactcctggaaagacacacacaacacctgctttgaattccagcctaagattttgatcatcttatggccagattcaggaggcttggctttctgcatgaaacatctctttcttcttaacttaccaacagatttttgttcttatgcctttcttccttctaaactttagcagtggtctgagagagggaattcttgtacttgcgttccttgtcttctcattcttcatggtaatgctgtctacagtagaagactctttgtcaaactgtgcagaaatggctaggttttttttctttgtttttgcttttattttttgaccttctctgaggcattttactggagctttcttaaattcgaaggagagaatttttactgaggctagaagttcgagttcattccttccttccataaatatttgttacatgcagcattcattttttggaggcacttactgattttatgaaagttaatggaggaaggactgaaatggattagtcacaaaataaaaaaagtcagtacaggtatatgtgctgggacatctcctttccggacccttccctcagcaatgtctccaaggtgctttaagtagctagatgctaagaccggacagattttcttttcccttagatatcaaaataattatttgccagaagggagtgcttgggaatggaggcataaattatcttttttaagttttcatttggatcgaaggtccaactaaatggcagagttcatacctaacatgcaaaaggtcccgatttcaactcctccccaaccaaaccaattatttaggcatagggccaactgaaactttgggaggtgtgtgtgtataaaaataatcttttccaatttttttccacttgggttttcttttttgtttgtctgtttttagcttgatggtgtgaaggagaaagcattggtctcatctgtccgtcagagaatgaagtgctccagtatgcagaagtttggagagagagcttttaaagcatggtacatgacttttctttaacatcacagttcgcatctttctgttgatagctgtctaatcaaaaaagctgtgcctttataaggcactttatgaaaagacaatagaggtgaagtcagaatagcagtaataatttgacatttttgtctcatcgttttgttttaaattatcaaggaatttagaagacttttttttttttttcctaagagaagataggtatttaaaatctcatttgtttataaagactgggactcattttcaaagcttacaaaatgcagtcctagtcagggtgatgaatttacttaatttatgttccctcagtctaaaactgactgttttatgtcttgataattgaatttagccatcaagccagctggagttactacttcgaattttattacaactccaattgtgttcttaatctcatgcttttgtttgaccctctctttgcttttatagctgtagctgagtctgggtgcaccctttaatatggcagccaagaaagatatgcttgctcttctggtacctcacctaaccaacacaataggagagaaggttgagatgactttgtgtgtgttctctagaaactgtctgcacaactttcctcactaagtcattcccactctccaaatgattacagccagatcaaccaaagaagcagcttcaatatgaaactgttacacgggctgtgactggctcctgcaaaggagtcttttactggagtaaaggaactgaaagttattttagaatgagaatcttgggttttgccatagggctcagaggctgtctgctggaacagcttctaggcaggaggatgcgtgtttagaactctccagttctctagaacttaagaacacccacaaccccccaactttaggactcagagaaatatgtcttatggtaaaagatgacgaatcttcatttccagatgagaatgctttcatgccattacgtaatttaatctcccagattctgcatgttgtaacactctaaaagctaacgcctgctggtggtcacagtgctaagatgggatcaaactgaaaacagaagtcagataaggacttaaagctttactgctgcccctttggggaaaatcttctatgattttaatttaatgaggtcttagctttccacacaccaccgccattcatttagtagataattctgccaaagaaaaacataactatcatgccagattagcattacaagaactaatgaatttttataatttgttcagttaatttggttttgaacttcaaaacagtttataataggttttgaacttgttaaaaatagtgtcttttgttattgctttcatacaaatacaatatgataattcattgatggaaaatctgtttgtttgtttttccttttcagggcagtagctcgtctgagccagacattccccaatgctgactttgcagaaatcaccaaattggcaacagacctgaccaaagtcaacaaggagtgctgccatggtgacctgctggaatgcgcagatgacagggtaaggaaggagtcattacatgctcagttgagcgcctgtgtttggcttcatcggagaacaccaagggcgggtggtgtggccggtattctaccaagctctccttggttgctgccactttccagaaaaaaagaccaaaacaaacaaacaaacaaacaaacaaacaaacaaaaaactccccccaaaaatccaaaaaacaaaaccaccaactcaaaatgttttcggaattattcaatgacccgaaactcctttcttcagtcacactttgagaaggcattaatggaagagaacaagccataaaatgtagatttctaagaggttttggggagagaagcaggggctagacatcccacagagcagagaggcttttaaaaatgtgtctatcccttggtggtctttcccctaatctactgtctgcgttaagtacatacagattcactgtgatctcattttctccaacattgtcctattatctccctcccctccctgctccaaagactaaaaatataaccaaataccagaatcctcttctaccatagtaccttccggaaaactcaagacagatattttgtatatgtcagcaagacctgtaattgtgctcattactgattatttaataatacttcatattctaatgggttatttagtttcaaaatgcctacccttaacttgggagaaaattttttttcaagcactaacttttatagaaaaagtaacttgaattatcaaagtcagaaagacatagatttaataattaaaacaaactaatttaaatagatacatagcttgcttcagaacggtctttctcggatctaaatggaatgttttgatcatagtatcctagtccacaggttctgcagcactgcagggctgagaacgagtttacagaaaccactttggttgtgtctggtttagggcaggatgaagacactttcctcacatgacagaggtgcagggacaaaatgtagctaagataattcctctgaaacctttgtttttcattctcacaggcggaacttgccaagtacatgtgtgaaaaccaggcgactatctccagcaaactgcagacttgctgcgataaaccactgttgaagaaagcccactgtcttagtgaggtggagcatgacaccatgcctgctgatctgcctgccattgctgctgattttgttgaggaccaggaagtgtgcaagaactatgctgaggccaaggatgtcttcctgggcacgtgagtagatgcctttcctttcatagctttgtcagagctgcatggtttaggactctacaccaggctttcctttggtgttagcaggacttctatggttctcagaaaaattattcatccttgccattttcagcctttaaaatttccttgaaaagtattttaagtaatttaaaatatttttttatgaaacatacatgcattcagcataaactcaatgttccttacttcataggaatatttctggaaatctttagaaatattctatgaatatgtaagtcatatgtaccacttaatcatttttatgagcatatatcttaaatacatagtgtatataaatatatcacctatctatctacttacatactcagctctatctagctagctctgtgatgatatcaaggatatctatttctatgtatataagcaacatgacactagttgtttcatccttggttgaaaagaccagaatatcacaatatagcaagacatgatgcaactaataacaaatgacaaaatattttcaaaaagtacagcaattatttccattgtacaatggagggagttaatgcattgattgattgattgattgattgattgatagttgcccacccagaatattaaaacaggtttcagtggcaaagctgaacgtgggaagagttctctctgggtcccacattcttgttgtttagttttctgcatggagctcgctccaatgcaggatgactgggctgagaatcactactgaggttggttatggggctctattacatattcatttacttaactcagcctatgttcatctcaattaggttcttgtatgaatattcaagaagacaccctgattactctgtatccctgttgctgagacttgctaagaaatatgaagccactctggaaaagtgctgcgctgaagccaatcctcccgcatgctacggcacagtggtaggtttccatgagccaagaacacctacagtgtggatggcactttctataaggacgagggaagagatgaagtcacgataatcgatatgtaggtcaatacagatgttttcttgagatggaggcaagttctagctctttaagttcttcagcatcataggataaactctttggataaaatataaggaaacctagaacaaccgctctagaaaagaaaggttcaaagagagggaggaatcttttcttgcacaaaatctttattgtagctttccctttttcatactcccaaggataaaattagagaataaagtccaatgccaactaaaattcatttattcaacttagatttaaggactattaacctgtcccaccacactatcaactattagaattaatatctcaaaggagtctgtaaactctatttctttactattttggaggttttggtgaagttttttgttttttgtttttttgttttgttttttttttttttgagaagttttacttgcaagtttgttgtagagggaatcaggactcctctcagctcatactagattctgaaccacttgggaccagaagagaatcgtactttacaaagaaactgctgaataccagataccactcagtggttgagcctcagggtggatacactcatctcagagacttcaagagagaccttagagagattgctaaaagtgatggccactatctagtgaacttctgctgtgcaccagttgatgttaatctcatccacttagtgggttaagagaccagttctggtgctgaggacacgtagcccagtacagtgcagacatgatccatctgaagcttgggtgtggaaagaacagtctcacaacaagaaagcacatcaggtggcctgcttcaagtacagccattgaatcccagagcctgaagattctcatttgacttgtgccaaatgaccttgcaaatacaaggaacaatttaaacgcaaggtgacagatgtggcacaaaagatctcctgacttgtcttttacttgtctttggacagagggatggcagtagtgtgaagtggcctactttgggctttcaggaaggggggctgtaaacacaattcttttattttgcagcttgctgaatttcagcctcttgtagaagagcctaagaacttggtcaaaaccaactgtgatctttacgagaagcttggagaatatggattccaaaatgcgtgagtagttttatcagctagttttttttttcttgatcagtttgtgattatttaaaacagcatacaggctatccagcatatggctttcacaatgaaaacattatttataatacagatctatcaagaaattctggcaaggagacagcttagttagagggacgaagagaactgtaaccctgcataatataaacactgatctcttgggagaagaagttttgaggactcagcaaatcttgatacattagaattcagagtgtccttcaagggttaggtggagtttatgagcaaacaatagaataatatttagtagaaaaagaagtagcatgctttgggcagcagaaactcaagaaccgatagaaatgctgaacacaaaaatataacaaaagatttagataaaatggaaacgttacatgaataggagttcacttggggaaaacattggaatttgggagttacagataaactttggtagttgtaaccttgtcttcctatggaatttcaatctcagagatagagactgaatggtcttctagagtcatttcatagaactttatctatggaagtaaagggagcatactggaagagacacattattccttgtttatttcatatacaattttagcactcttgcaactctagagtttggagtgggcacttcttcaccgaaataaattgacttttattggttatggtacattattaaacaccagatgctattaattgctagataatgtgtcaggcagacatttttttcctttcctttaatccatgcatggtttccagtaaaccatttctcttttcacctctatcttttgagtccgtcacaaagttgatatgagtaagtttgtgttagaatttatttaaagcagcactgagtacattaatgccattgggttagagaaatgtcacttccttatgattttactacagatttaaacttaaggtcttatgctcccagtaggtttttttttttttttttaacagatacttggtttctcaggacaaggtcttcttccagtactatgccaccctagtagtaaagataactttgattagtggggaaaaagtcttagttgggttgggtgaatcgtctcttcttgaaatctattacatctggccagttttctgcctggattaaaccatgtaacttattttttgctactcagcattctagttcgctacacccagaaagcacctcaggtgtcaaccccaactctcgtggaggctgcaagaaacctaggaagagtgggcaccaagtgttgtacacttcctgaagatcagagactgccttgtgtggaagactatgtgagtcttttaaacaccaacaaagttaacagggctgggttgttatctttagaccctgataaatctaactttcaggagcaaggggggtcctaatacatgcatatgtatgtgtgtggtatctgggtcatggccccccatatctaactgagaaagaaacagtttttaataagtctcacatgtgtagtttcaaagatagataaattgccatgccaatcaaggctggatttctaatggctaactccatatgacagtttttagtgtaccagaaagtggatgtttgtgaaatacttgtgacctttctactctctcttctttagctgtctgcaatcctgaaccgtgtgtgtctgctgcatgagaagaccccagtgagtgagcatgttaccaagtgctgtagtggatccctggtggaaaggcggccatgcttctctgctctgacagttgatgaaacatatgtccccaaagagtttaaagctgagaccttcaccttccactctgatatctgcacacttccagagaaggagaagcagattaagaaacaaacgtgagcaatatttttttattgcatctattttcatactgcatatgtattgatagtgagaactgacaactggacatttttttgttttgatgcagtgattatatattccttagagagaagtgtttagatgttggcatcactgagttgaaagagtgtcaaaattttttgtctctgtgaaaaaattttctattaaaatctttcattcaacttatctttattactgtgggcaaaaaccacagtagaataaaattctagtggaggcccaatagaagacactaaataccagttagtggatatagatagaagaactggtcatggaaatcatacaagtatttattgcaaggtaggaatagttgattgaaaatgttccacgtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggacctgcaaccctataggtggaacaacattatgagctaaccagtaccccggagcttttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaat

SEQ ID NO: 35 - DNA, 23 bp, Artificial Sequence
  Malb353F primer
catataggacgagtgcccaggag

SEQ ID NO: 36 - DNA, 43 bp, Artificial Sequence
  Malb2382R primer
ggttacccacttcattttgccagaggctagtggggttgatagg

SEQ ID NO: 37 - DNA, 30 bp, Artificial Sequence
  Malb6310F primer
ccgctcgagtgaagttgccagaagacatcc

SEQ ID NO: 38 - DNA, 30 bp, Artificial Sequence
  Malb13382R primer
acgcgtcgacaagagacgattcacccaacc

SEQ ID NO: 39 - DNA, 27781 bp, Mus musculus
ggaatgagaaatacacatagaggtcagtaatgtgaatgaagtaaaatagaaagaattagatttaaaagctaagttcacacatactaagtcctagattgtgaaggaggaagggaggttgagagaccgagagacggaggcagaggctggtttaccctaatggttctggttagtatgtagtgacttaatggaacccaatcttgctttttattcccaggaatgttgtgggcacaacaccctgatttgtaggttgaggaagttgacaggcattggcttatcgcttcctatctccagaactacacagaagggatggatactggaaaatctccagcttaccgggggttagtatggccatgggagtgaatgagaagctgtgcgatagagcagaatcagagacagcgactgccacaagaagagataaagtggagctttgaaccacagtttgtgtgctgactgcaaacagggttaaagcttgctgtgccattgctcaaagcgcagtcctaagtacagagtccatgcttttccggctgctctgactcctgttgttgactttttccataaatccttgaatcttcccaggtacaatgtgacccggtaaactgaactctgccatcaaaaagatgctaatcttgcttgtgcccgttgcttgccatacgacattcagcaaataatgtaatatgactgaatctggattttatcatttgtatcacagaaacaatacctctcctcaagtgtacattcgtgtggaggtggaatgatgtatcctaagtgctgggtggctacaaatatttctaaaaagatgagagtaaatatcaccattcttaggactggtatatttaaaatgtacagttaaactgcacatgtgagttagcagaaaatgactttcactctttcaggatcctttgtgtgtgtgtgtgtgtgtgtgtgtgtgtgtgtgtgtgtgtgcaaatatgtgtccctgaaagcacagttcttacatttctagtgccttacccatcaatgcttatcaaatcttaccactactcttcaaggtacagatcatataattgtctgtgtgtgtacccaagtgctcactggagaacgtccctctctgacaacgtctaacgctctttagatcgtttcctcacggtgcttcccatgcgccctcacatcctagtatgctgtgagccacctgaattcacttcttgaatttcccatggtggttagcacctatgaaacacagcacaatctttacaaacagaaattaagtgtcatcgaatcaaatgggagtaagactttatgccctcaaatgaatgacgcatgtctcatgctcttctggtaacagaatgtttgtgaaatattcatgcattctcttatctaaggctgggattccacaggcacaggagcctatgtgagaatgggatggaatctggcatcttgtgaggaagccaatgcttgtcatcttcagactttaaaaggaaccctgcaaagcagacagactccaactacaaggagtgtttcagaccactaggaccctcctgactctgaagattttgttacacctacccttttctcttgttatctgtgggtagaaaacagactcatggctattatagtctccatatcgctgggacctcaaggatttaagaaagcagcacacactttgccttgacattttcttccccattccctgatgctgttaagttctctttacttatcctatacatgtttcttgagtccatatgtgaagaccctccccactctttctcagggaacccctaacatatgattacatcaaagaactagaagtcaaacatagaaagatgtttctgctgtgtgtgaagatgtgtaaggagcatcacactgctcatgttgaacctaaccaatgtcttctctgctgctttcttcctcagtctcttcacatctagccccagatgtcacgtaactgtccccttggttggtttctgtcaactctccctcttttgtttagtttaatctgatctagggggaaatgccttccacacttgctgtgaccatgttttgctcaaaggaaaatcaaaatgggaaaaaaaaaggactgttttccttcatcaaaggaattttatctttggatctttggtgtttaggggagaaaatatttttttttcccccacacaggaacaaactaaaagagatcagagacaaattgggcaaccgagctgcctgtcgaacttaaaaggacagaaatatgtcaaagtcaataaaggtgcacccagacatcgatataggtcaagcagagctacagcaatgtcagtggagtgtcaactgaaaaccaggttcacaaaaatgtacattctacatgcagtgtttgcccctctttgggttagcctctttggacaggctgggtaggggtaggggcccttaaaatagaaaattggtccacacagtcaaactataaaccactttggggaaacaccacatctggaacaatgacacatacagaaaaattcctccctaaatacttgtctggtggtgatctcttcaaatggagccctcttcccagctgctagagcaatgggcagatgtaggaaatatcaaatgaatgctaagccttctgccagactccctgctggacactcctttgctgatgagtttttctttgcgctgctctcacaaaatgctagggatgaagaaatttacagataatataaatgtatttttctattctgaagccttgggggttcaaggtcacaaggtccccatagactcaatgtctaacataggtcattcttcaaatatagtgccataaatggcataagggacagaaacaccagcaacactagtaacatccctcaacctctttcttgagaataaccaactggctgtgacagcagatgcctgtgatcccagaactcagtaggctgaggtaggaggattgccacgagtttgaggccaacctgagctatatatcgagatcagttctcaaaacaaaattactaatctatccataagaacagaacccctactgacaaactggacctcatgaaactgaaaagtttctgtaaggcaaagaacactattaataggacaaaacagcaacctactggtttggaaaagacctttattaactctacatccgatagagggataatatcaaaaatatataaagaactcaagaagttagactccaaaaaaaaaatccaattaaaaaatggggtactgagctaaacagagaattctcagcagagggattctgaatggctgagaaacacaaaaagaaatgttcaacatccttagtcatcagggaaatgtaaatatcatagaccctgagattccacctcacaccaatcagaatggctaagatcaaaaactcaggtgaaagcagatgctggtgaggatgtggagaaagaggaacactcctccattgctgctgggattgcaagcttgtacaaccactctgcaaatcaatctggctgttcctcagaaaattggaaattgtcctacctgaagaaccagctataccaattctgaatatatacccaaaagatgctccaccataccacaaagatacatgccccactgtgttcatagcagccttattcataatagccagaatctggaaacaacccagatcttccacaacagaagaatagaaacagaaattatggttcatttgcacaatggaatactattcagctattaaaaacaaggacatcataaattttgcaaggaaatggatggaactagaaaatatcattcctgagtgaagtagctcagacccaaaaggacatgcatggtatgtactcctttaagtggatattagccaaaaattacagattatccatgatacaacctacagaccataagaagtttaataagaagaaagacccaagtgaggatgcttcaatcccacttagaagggggaacaaaatcacaggaggcacaaggagggaggcacctgggtgggagaggggaggggggaaaggggaacaggatcaggaatgggggagggggtcagggtaaacatgagagaagcccagagggtcaggagaatgaatggaaatatgcagctgcaagggtggagggggtggggagggggcgggggaacctctagaaagtcccagagaagtaggggtgagaggcttccaggactcaatggggatgaacatagtcaaaatgtccaacagtagggggatggaacctgaagagaccacctccagaaggtagacagggcacccactggaaggatagagtcatcaacccaccttcaaattgtttgacccagaattgttcctatctaaaaattatatagggacaaaaatggagcagagactgagggaatagctgaccagggactggcccatctggggatccatcccatgggctggtaccaagccctgacactattactgatgctatgttgtgcttgcagaaaagagactaacatggccgtcctctgagaggctctaccagcagctgattgagacagatgcagatacttttagtcaaccattagactaaggtcagggacccccatggaagaattagtggaaggattaaaggaactgaaggggatggcaagcccataggaagaccaacaatatcaactaacccaaacccctaggagttcccagagatagcatatatatagcggaggactgctttgtctggcctcagtgggagaggatgtgcctaatcctttagagacttcatgccacagggaagggggatgccctgtgggggtaacttctcaaaggcaaaggggagggagtatggggtgaaaggaagggcaatgtttggaatgaaaataaataaaatgataaattaatttaaaaaaaagaacagagtcccagtggtttaataacttgctaaatgcctttagcaattactgtcaccttggaaattaggtctccacataagaatttagaaaggacatgaatgcttaaactgtagcatatagcaaagctggtgatggcttacaggtgattcagaaacacccccccccccgcagcccataatatgccttcataagaagagacttctgagcagttgcttgttctctgtggtgtttgaggacaacctaagaagcaatcatatttgccacagtgcagaagcatcttaatttgggaaaatattctgttgcagccaaactctgagctttattttttatagttttccaaagaccgggactaatcttaacccccacagctttgtcttgtgttgcttcaatcactagaaggtttgggaccttcataaatcacaagcccattactctggttgcaatgaatgagagcttcaccctcctcaaacagaatgtactcttctccatctttatgacacccaggccatccacccttgctcaccagtgatactgctcctcaactcagctcccctcttgaggttctttcattctctattctctcatatgttatatcctgactgcaattcccttccatccccacctccccttccccagatccacttctgcctccccttagaagagagcaagtctcacaggaacatcaatcaaacatggcaaaacaagctacaataacaccaggtacacaccattgcatcaaggctggacaaagccctgtaggaggaaaagggccccacaagcaagcaaaagagggagggacagcccctgtgcccgctgttaggaatcccacaagaacaccaagctatacaactataacatatatgcagaggacccaggtcagacccctacaggcttcctgatctctctgagcccctgtgagtttcaggtagatgtttgtgtggtccatgttcttatagtgtccctgacccctttggttcctccaacccttcctccccctcctccacaagattcaccaagttctgcctaatgtttggctgtggtactctatctatccccatcagttggtggctaaagccactctggtctctctgatgaccattctactaggctcctataccagaacactctgcaggcagaatgaactataggtcaaaggttttctggctgctttagtgtcctaatccctccacttgcctggttacagacacagctcagcctctgtgtcccccattgctaggagtctctgctagagattcttgagatcaaatttttaaggaatcagtcaaacatatttagagaaactgaagtaacctgagttaatatatagaacaaatacaaataaatggtaatcacttgcatataatattttaaattattggctagtctaaagtttacagtctacagttgaagaaattaaacaaggtttctgtgaatgaaataacttgaacaaatcatttattactctacttatccatcaaccatgaaatataatattaaggtaaatcttccattagtcaaaggataattcttcctttccccacttatctcaaaatattaatgttcttttttagcgtcacacaagaatattcacctatttgctaatcagttggtcacataacaaatgcaagctggatgaacctggatgaaataaatcgaggcacaagtggctcaaccatatgaaagagtaattagatttatcattattgaatataacatttttgatgtacctaatttggggagttatttcacattttaaaataaaatgaattattattaccataaagggcaagattgcatgactcagatccatgtaggttcacaatttactctattcaccattttgggagtgcagggtgaatcaggattctgtgatgttagcttgtgtgattatatcatgacactatgacagctacattgctaggtgaaaggaatttttcagtgctgtttttatcttgtgagaccactatattcacaccctgtccttaactccagaatccgtgagtaacacatgactgttctgtcttcttccgtgtcaagtgcatcgtattcttgctaacttttgtaccttcaacctcatgaaaaccatggtaatgtcatgtctcatgactcatttgctctgaggaatcaatattgatgcaaacaaatcatcttgccaccatattttctttctcattaagcatttaatttaatgtcgtaacatcattatctctactatagcactgatgatgtcactatggattctggcctcggttaactcacttagatgttattgtgatgtggctttgatgaaaaccatagggcaagcctctggtcatgtgagggttctatttagttttctttagcataaacatctagtaatgcaccttctataccatttctaccctgtgttcagtgacgttggtcactacacctatgtcttatagtcacaaaaaaagagtagttacacagctgactataagaaaagggaagtggttatattcctggaaaggcaataccaacttgaggaaacacagtgtgaacacactgaagaaagcaagataggatgcactaaaaaggcccaagagagtgacagacaaatagtcttcaaatacctgggatgaagtaggcatgccactcctggtgactgagagagaattgagatggagtttgtggagagatgggaatgaacgccctagataacattagcagagagtgcactgggagaagaatgcttgctaccctctctgctacctttttatactatcaacggaggcttctctactgaaatataggaaagacacaatggaccgatctgtgcagtataaaccaaagaatcattcaaaagacagcctaaatttgtcttgtatcctatgtaaatgtgattcaaactaaactataccataacctcactgaagaatataaagaaaaaaatagaattgacctaagtaactttggaaaacaatattttgcctaaaaactataaggttaaagacaaaagaaattccatgtaagtactatatcctagttgttgatggttcttatggaagtatgaggtcaataattctgaagctccttaacatatatcctgggcttaaacaaatatataatataaatatatatctgagggcagatagtgggtgacaagtcctcacaatcaaaaggacacttatagatcagcaagaggaaagttggactgagccttgtggctctgaaagagagtcagaattatcagttgaaactcttatgtgcatagatagatgagagagagagagagagagagagagggggggggagggagagggagagggagagggagagagagagagatatgatggtgatgatgtgtgtgcatatgtcttcatactttatgtttcttagttctactctacaaagttgtataaacagtgagccctcactaacgaggggcagagccagtaaacagatctttgcaataccattctctaatgaaaggaaccaggactgttccccttccagaagcttagtacctttcatgtctcactttggtgagagagctgtagttaacggtttgctcccccagaaagactctgcaaggggaaagtaataactgcacagtgaggaaacttggcaaacaccgcctttaaggaaataaatgatcagcctaacatcctgtgtcaagtcacgctgacaacataacctgttcccagtgttctatgagaccatctctaacacacacacacacacacacacacacacacacacacacacacacacacacacacaggcctggaatattctagcaacccagccttctggatcatgaggcaaaatacaagaaaaacagatagatggcagacagataggaattatttccccatggatgccctctcaaaaacagagctcactgggctctttagtttcatgtgttgactctgtggaaagcagaagtggctcaggaaatagtgcttgaaaggcataattctcttaaagttttaagctcccctttggtatgtcggagtgggtactgaaccagtgcccttcagatagtgcttccacacctggctcgttattagcccagttgatagcaacaccttactcgaattgtctggctaaacttaatggtttccatcaggccagggcccaatctccattctaccctcccagtctttttctctttgatactttcaccaggaggccaaagctcaggttgaaggagaagagagtgtggggcacgaggggagtgaaaaggacctttctttaatatggcctcatcatcacttcaagtactatgcttaaagtaaagctataaaggataagtaagagctggttgaagaataatgtgcacaatctgaagccaggtctgtaataaaaatgtcatatggctataaatgactgtgtatgtaaactcatacacagcacttggacaagtctataaaattcatagaccaaagtgtatatgaacaactggctcctggaatagagagaagaacccagcagtgaaggcagcatctaaattttaacatgaccctttgaccacgcaactctttagattcatcaatccagcacccctcccgatcacccagtttcctcttccagcaggacttctcaaggttttagcctgtcatcttgagtgatattttttttcctcagttcatttactttatcagttcaactagtcacctttaaagccattcctatctcttttgtccccaactcattcttagagtcccactgacaaaggaaagccacagttcataagcttttagtctctcattcagaattctcgtaatgttgaagtattggtttctagggtcaccacccataagatgggagagtattaacgtttattttcattgtgttgcccatgtggaactacattctctgctgagatgaagggaggaaaggcagggattcctctgagccaaagaggctgctagggtgaagcgcgcctttggaagatagagttctgaaccacagagtagattctttccattttttattaattgcagcacagagacaagaagtcaaatgtttaaagaaatttgtgttccttagggtgttgattttacaccaacagaaaagatgagtcctgagtcttcatgtctttttttctcagggtagcctggaaaacaaaaagagaaatgtaagtgtcctttgtaaaatggaatacggtttccaaacctattttctagaaatgtggaatttcttagattctttttgcgattttcactggtgtagacagcctacacatgacctagtcttagctgacatctgttacttggtgggcagatgacacactgatagatgttgtgacaccctctcaccccaactcgtgcatgtgtgatataagttgtgccctcttcatcactggtccctcagagtccccaagtgtcaaagtcaggggtctcaccatttctgaggacctacatattacctatgattacaaatgaaagctgtcttctcagaatgctacaaaactttcaattctttctaaaactgaaataattttgaaatagccttatgtctataggttctttgcttgaataaaaaaataagttttttgttttcatatggagaaacaatttttttgccaaagccttccattattgccctattttaaaaaattctcttctgcaagattataaacaaaattgatcaacatagctgtgtgcagttggctatattttcaaaggaggctgctttgtcataagaagataaattctgttaaagcttagcatggggcacatcagaaatttggaagtggatcacttattatgaaacagaacccgttgtatcttctgttgaaatggattcacagaatgattgggtcaaaccacatggaatcattgatacacaactgttttgacccaccccccaaatattccttcatatggtttcaacttcatccagaggataagcttgactaggctaacatggaggactccacatagtggttcatgtaagtcagagcaaaaccagggctaactcctttgctctggtttgaatttttaattttggttccttctctccctggtttggtctccttttgtgtaaattgcattaacctagacctttatatgttcagtttcttatctacaaatggaacccaaactgatgaccatacgtgaagacctaagagtgccagctggtgcttgtctgtatggctcttgtcaaatggttatcagtcttgatcgttttaggaaaaatgattatgattatgttttttaagtcccaagtatagttacctgagaaggttgtggttgtgatgtgtttaggctaaggcgtctttgcatctagtgacaaggtttggaccctgaaaacaaagaaatgatggatgttagaaaagtattagcaggactgttaggatttgcacttcatagccataggcaatgacatagtaaacgtacgtgccttgcattgcttaattacagttctacttagaattcctaaagcaggctctctgacatctgttgtgcccaaaataagaagataaactgttgttaggccatgggagggaatgtgaaatgattcagatatataatggtaactgtccattcatgtgtaaaataactcaattcaaaaagaaacatttcagggcaaggtttaaatgagttcatgattctaggctttgcaagtatttctaactatgctcttctgtgtcacaaatttgaaaccaaatagtgataataggtatttaataggcagcagtgtggcagaaaataaaaattaaaagctacgtaagtcagtttctattacagttacgtagagaacaacatctagattggtggagttattcagtgtgtgagttccagagagctacacctgaccacgtgcacagaaaatggaaactgaacatcgtcaaaatgcaaaaacgtttctgacctcagtcgagaagcaggtgtccttgtcagcagccttgcaacatgtatccaggaactgtgcaaagtcatccatgacagtcttcagttgctccgctgtagccttgggcttgtgcttcaccagctcagcaagagccctgcagtaggacagaaagcaagaagagcaaggagacatttaccccagtgcaggaaagtaagataggaaggaatgtgaggccacagtttaaggctataaatcttggagccaagtaactttggctttgaggattaagcatgccactgccaacttaggaatcttggctgtgtaggaggggagtagcagttgtcactttgctaggactagctagatcaaatagaataatcgatgccagtcacacgggttttgtctagtttcaggaaatctcctgaaaggctttgcacttaatatgtggatttttgccctcctaacacctgccccatttgaaattaataatggggaggctagaaagactgacaagccaagcaataggagatggctgggcctctgttgttgacatctgtagaacaaacagtaccagagacatagtgctgtgtaggggatgagttttgtaactctgtctggggaccatgatgacatgtccccaaaggtgatgacaatatcccgctacattttgtagtattggaacctctcccttcagcagggttcgaacctcctatgtacacttccagctgtttcttactccattctcaaaagtcacacccatgacgttgccttgcccctgcatggcttcttcgtggaacattttctttttttttttttttttttttttttttttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcaggtccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtacgtggaacattttcaatcaactattcctaccttgcaataaatacttgtatgatttccatgaccagttcttctatctatatccactaactggtatttagtgtcttctattgggcctccactagaattttattctactgtggtttttgcccacagtaataaagataagttgaatgaaagattttaatagaaaattttttcacagagacaaaaaattttgacactctttcaactcagtgatgccaacatctaaacacttctctctaaggaatatataatcactgcatcaaaacaaaaaaatgtccagttgtcagttctcactatcaatacatatgcagtatgaaaatagatgcaataaaaaaatattgctcacgtttgtttcttaatctgcttctccttctctggaagtgtgcagatatcagagtggaaggtgaaggtctcagctttaaactctttggggacatatgtttcatcaactgtcagagcagagaagcatggccgcctttccaccagggatccactacagcacttggtaacatgctcactcctggggtcttctcatgcagcagacacacacggttcaggattgcagacagctaaagaagagagagtagaaaggtcacaagtatttcacaaacatccactttctggtacactaaaaactgtcatatggagttagccattagaaatccagccttgattggcatggcaatttatctatctttgaaactacacatgtgagacttattaaaaactgtttctttctcagttagatatggggggccatgacccagataccacacacatacatatgcatgtattaggaccccccttgctcctgaaagttagatttatcagggtctaaagataacaacccagccctgttaactttgttggtgtttaaaagactcacatagtcttccacacaaggcagtctctgatcttcaggaagtgtacaacacttggtgcccactcttcctaggtttcttgcagcctccacgagagttggggttgacacctgaggtgctttctgggtgtagcgaactagaatgctgagtagcaaaaaataagttacatggtttaatccaggcagaaaactggccagatgtaatagatttcaagaagagacgattcacccaacccaactaagactttttccccactaatcaaagttatctttactactagggtggcatagtactggaagaagaccttgtcctgagaaaccaagtatctgttaaaaaaaaaaaaaaaaacctactgggagcataagaccttaagtttaaatctgtagtaaaatcataaggaagtgacatttctctaacccaatggcattaatgtactcagtgctgctttaaataaattctaacacaaacttactcatatcaactttgtgacggactcaaaagatagaggtgaaaagagaaatggtttactggaaaccatgcatggattaaaggaaaggaaaaaaatgtctgcctgacacattatctagcaattaatagcatctggtgtttaataatgtaccataaccaataaaagtcaatttatttcggtgaagaagtgcccactccaaactctagagttgcaagagtgctaaaattgtatatgaaataaacaaggaataatgtgtctcttccagtatgctccctttacttccatagataaagttctatgaaatgactctagaagaccattcagtctctatctctgagattgaaattccataggaagacaaggttacaactaccaaagtttatctgtaactcccaaattccaatgttttccccaagtgaactcctattcatgtaacgtttccattttatctaaatcttttgttatatttttgtgttcagcatttctatcggttcttgagtttctgctgcccaaagcatgctacttctttttctactaaatattattctattgtttgctcataaactccacctaacccttgaaggacactctgaattctaatgtatcaagatttgctgagtcctcaaaacttcttctcccaagagatcagtgtttatattatgcagggttacagttctcttcgtccctctaactaagctgtctccttgccagaatttcttgatagatctgtattataaataatgttttcattgtgaaagccatatgctggatagcctgtatgctgttttaaataatcacaaactgatcaagaaaaaaaaaactagctgataaaactactcacgcattttggaatccatattctccaagcttctcgtaaagatcacagttggttttgaccaagttcttaggctcttctacaagaggctgaaattcagcaagctgcaaaataaaagaattgtgtttacagccccccttcctgaaagcccaaagtaggccacttcacactactgccatccctctgtccaaagacaagtaaaagacaagtcaggagatcttttgtgccacatctgtcaccttgcgtttaaattgttccttgtatttgcaaggtcatttggcacaagtcaaatgagaatcttcaggctctgggattcaatggctgtacttgaagcaggccacctgatgtgctttcttgttgtgagactgttctttccacacccaagcttcagatggatcatgtctgcactgtactgggctacgtgtcctcagcaccagaactggtctcttaacccactaagtggatgagattaacatcaactggtgcacagcagaagttcactagatagtggccatcacttttagcaatctctctaaggtctctcttgaagtctctgagatgagtgtatccaccctgaggctcaaccactgagtggtatctggtattcagcagtttctttgtaaagtacgattctcttctggtcccaagtggttcagaatctagtatgagctgagaggagtcctgattccctctacaacaaacttgcaagtaaaacttctcaaaaaaaaaaaaaacaaaacaaaaaaacaaaaaacaaaaaacttcaccaaaacctccaaaatagtaaagaaatagagtttacagactcctttgagatattaattctaatagttgatagtgtggtgggacaggttaatagtccttaaatctaagttgaataaatgaattttagttggcattggactttattctctaattttatccttgggagtatgaaaaagggaaagctacaataaagattttgtgcaagaaaagattcctccctctctttgaacctttcttttctagagcggttgttctaggtttccttatattttatccaaagagtttatcctatgatgctgaagaacttaaagagctagaacttgcctccatctcaagaaaacatctgtattgacctacatatcgattatcgtgacttcatctcttccctcgtccttatagaaagtgccatccacactgtaggtgttcttggctcatggaaacctaccactgtgccgtagcatgcgggaggattggcttcagcgcagcacttttccagagtggcttcatatttcttagcaagtctcagcaacagggatacagagtaatcagggtgtcttcttgaatattcatacaagaacctaattgagatgaacataggctgagttaagtaaatgaatatgtaatagagccccataaccaacctcagtagtgattctcagcccagtcatcctgcattggagcgagctccatgcagaaaactaaacaacaagaatgtgggacccagagagaactcttcccacgttcagctttgccactgaaacctgttttaatattctgggtgggcaactatcaatcaatcaatcaatcaatcaatcaatgcattaactccctccattgtacaatggaaataattgctgtactttttgaaaatattttgtcatttgttattagttgcatcatgtcttgctatattgtgatattctggtcttttcaaccaaggatgaaacaactagtgtcatgttgcttatatacatagaaatagatatccttgatatcatcacagagctagctagatagagctgagtatgtaagtagatagataggtgatatatttatatacactatgtatttaagatatatgctcataaaaatgattaagtggtacatatgacttacatattcatagaatatttctaaagatttccagaaatattcctatgaagtaaggaacattgagtttatgctgaatgcatgtatgtttcataaaaaaatattttaaattacttaaaatacttttcaaggaaattttaaaggctgaaaatggcaaggatgaataatttttctgagaaccatagaagtcctgctaacaccaaaggaaagcctggtgtagagtcctaaaccatgcagctctgacaaagctatgaaaggaaaggcatctactcacgtgcccaggaagacatccttggcctcagcatagttcttgcacacttcctggtcctcaacaaaatcagcagcaatggcaggcagatcagcaggcatggtgtcatgctccacctcactaagacagtgggctttcttcaacagtggtttatcgcagcaagtctgcagtttgctggagatagtcgcctggttttcacacatgtacttggcaagttccgcctgtgagaatgaaaaacaaaggtttcagaggaattatcttagctacattttgtccctgcacctctgtcatgtgaggaaagtgtcttcatcctgccctaaaccagacacaaccaaagtggtttctgtaaactcgttctcagccctgcagtgctgcagaacctgtggactaggatactatgatcaaaacattccatttagatccgagaaagaccgttctgaagcaagctatgtatctatttaaattagtttgttttaattattaaatctatgtctttctgactttgataattcaagttactttttctataaaagttagtgcttgaaaaaaaattttctcccaagttaagggtaggcattttgaaactaaataacccattagaatatgaagtattattaaataatcagtaatgagcacaattacaggtcttgctgacatatacaaaatatctgtcttgagttttccggaaggtactatggtagaagaggattctggtatttggttatatttttagtctttggagcagggaggggagggagataataggacaatgttggagaaaatgagatcacagtgaatctgtatgtacttaacgcagacagtagattaggggaaagaccaccaagggatagacacatttttaaaagcctctctgctctgtgggatgtctagcccctgcttctctccccaaaacctcttagaaatctacattttatggcttgttctcttccattaatgccttctcaaagtgtgactgaagaaaggagtttcgggtcattgaataattccgaaaacattttgagttggtggttttgttttttggatttttggggggagttttttgtttgtttgtttgtttgtttgtttgtttgttttggtctttttttctggaaagtggcagcaaccaaggagagcttggtagaataccggccacaccacccgcccttggtgttctccgatgaagccaaacacaggcgctcaactgagcatgtaatgactccttccttaccctgtcatctgcgcattccagcaggtcaccatggcagcactccttgttgactttggtcaggtctgttgccaatttggtgatttctgcaaagtcagcattggggaatgtctggctcagacgagctactgccctgaaaaggaaaaacaaacaaacagattttccatcaatgaattatcatattgtatttgtatgaaagcaataacaaaagacactatttttaacaagttcaaaacctattataaactgttttgaagttcaaaaccaaattaactgaacaaattataaaaattcattagttcttgtaatgctaatctggcatgatagttatgtttttctttggcagaattatctactaaatgaatggcggtggtgtgtggaaagctaagacctcattaaattaaaatcatagaagattttccccaaaggggcagcagtaaagctttaagtccttatctgacttctgttttcagtttgatcccatcttagcactgtgaccaccagcaggcgttagcttttagagtgttacaacatgcagaatctgggagattaaattacgtaatggcatgaaagcattctcatctggaaatgaagattcgtcatcttttaccataagacatatttctctgagtcctaaagttggggggttgtgggtgttcttaagttctagagaactggagagttctaaacacgcatcctcctgcctagaagctgttccagcagacagcctctgagccctatggcaaaacccaagattctcattctaaaataactttcagttcctttactccagtaaaagactcctttgcaggagccagtcacagcccgtgtaacagtttcatattgaagctgcttctttggttgatctggctgtaatcatttggagagtgggaatgacttagtgaggaaagttgtgcagacagtttctagagaacacacacaaagtcatctcaaccttctctcctattgtgttggttaggtgaggtaccagaagagcaagcatatctttcttggctgccatattaaagggtgcacccagactcagctacagctataaaagcaaagagagggtcaaacaaaagcatgagattaagaacacaattggagttgtaataaaattcgaagtagtaactccagctggcttgatggctaaattcaattatcaagacataaaacagtcagttttagactgagggaacataaattaagtaaattcatcaccctgactaggactgcattttgtaagctttgaaaatgagtcccagtctttataaacaaatgagattttaaatacctatcttctcttaggaaaaaaaaaaaaaagtcttctaaattccttgataatttaaaacaaaacgatgagacaaaaatgtcaaattattactgctattctgacttcacctctattgtcttttcataaagtgccttataaaggcacagcttttttgattagacagctatcaacagaaagatgcgaactgtgatgttaaagaaaagtcatgtaccatgctttaaaagctctctctccaaacttctgcatactggagcacttcattctctgacggacagatgagaccaatgctttctccttcacaccatcaagctaaaaacagacaaacaaaaaagaaaacccaagtggaaaaaaattggaaaagattatttttatacacacacacctcccaaagtttcagttggccctatgcctaaataattggtttggttggggaggagttgaaatcgggaccttttgcatgttaggtatgaactctgccatttagttggaccttcgatccaaatgaaaacttaaaaaagataatttatgcctccattcccaagcactcccttctggcaaataattattttgatatctaagggaaaagaaaatctgtccggtcttagcatctagctacttaaagcaccttggagacattgctgagggaagggtccggaaaggagatgtcccagcacatatacctgtactgactttttttattttgtgactaatccatttcagtccttcctccattaactttcataaaatcagtaagtgcctccaaaaaatgaatgctgcatgtaacaaatatttatggaaggaaggaatgaactcgaacttctagcctcagtaaaaattctctccttcgaatttaagaaagctccagtaaaatgcctcagagaaggtcaaaaaataaaagcaaaaacaaagaaaaaaaacctagccatttctgcacagtttgacaaagagtcttctactgtagacagcattaccatgaagaatgagaagacaaggaacgcaagtacaagaattccctctctcagaccactgctaaagtttagaaggaagaaaggcataagaacaaaaatctgttggtaagttaagaagaaagagatgtttcatgcagaaagccaagcctcctgaatctggccataagatgatcaaaatcttaggctggaattcaaagcaggtgttgtgtgtgtctttccaggagtttaccttcggggtcaggcagctttccttgtcagcctctgcacaacactgggtcagaatctcattgtactgctcagcatagtaaagaagttctggggcatagaaataaggatgtcttctggcaacttcatgcaaatagctgagttatgggaaagaagaagaagaaaacaggcagttattccccacagaacaatactacagaaatgattagaatcaacccacacccttggatacacatgggatttgtaattgaccggtttcactcagtgtggtcacccatgagtgatggactttgtctgttgttaagtgagcaaagagagatatgtagatatgtgtgtgtgtgtgtgtgtgtgtgtgtgtgtgtgtgtgtgtgtgtgtgtgtgcgcgtgtgtgtttgtaaatgttcacacatcatgtgtacatttttggtaagtaaattttggtgatgtaatgttgatgactaaaatgaaattgatccagagaacatgaacaccacacacatactcatactcacacacatatacacgcacatgcacacaaatgccttcagaatattttgcaacttctcagtctcagatatttcacacaggtcctgttttcaatatcaaaacatcattgatctttttactgtcattgtatagtctgtggtatcaagtattatgtttttaaacaccatctcaacacattcccagacttggtgttggatgcttggggttttcatgactatcagcataagtgttactaacggagctattgcccagtttttagcataaagtgtagatgtctgggtactcactgtcccataaaggtggttgggttttccttaaaggaggtgcacatggcctcagcctctggcctttcaaatggtggcaggctggggttgtcatctttgtgttgcaggaaacattcgtttctttcgggctcttgttttgtacagcagtcagccagttcaccatagttttcacggaggtttggaatggcacacaacttatctccaaaaagagtgtgctaagaggaagagagaaaagtcaaattcctgccggtaccccaactttcttcatagccaaagagcagcatcaaaaccaaatgtgctgataaaaattggtgaagaaaacatgtaccttgtatgtatgtgcatagatgatatgtatattgataacaccttgagctatatattatttttttggttctacataccacttaaaataaatttaagtataaaaaaattgttaatgaagtaagttacgtttttaaactgcgaggcaaacgaagatcatgtagaaaccccctaccacttactttccttggacttgtcaatttctgtgtaattttcatgatagtcaagtgccacaatattgtgtatgatggataacacagagaagcaaagagctaatggccttgaggaatgtcaccttccatgttttctatctgacactaaaagctaggagtaaagtcattataataaaaacaaatcaagggaatttgaggagcaggtaaaatcaagctggggaaccttgcacagctcctcatgggctctgctcctttgggagaagcctatgtttttactacgttccctgtaaaactaaagaataatacctccctccctccaacccctccctccaaaccctctcatgtaagcccccttgctctctttcagatccatgacctcagttttcattcattgttgttacatgcatatacatttatgtaaatacatgtatattcctaaatgtagcctgcttagtctgcatgttattcatacgtatgttttagggatgaccattggtattggagaggcagttggtatgctcttccaaggcaacttcttctctctgcattccttagttgcctacagttctttttacagggtttagctcttgtggtctttccctcatccactttggcatatctactgtcactgtcactgtcaagctcccatttgggcagtcatgtggtgagactttttgagtgtattgtagcttctgcaattactatgaaatggagtcccacagaaaattcccatcaccctggctttatcaatctctctgctgccctctgccacagtgttcccggggccttaagtgatggagtcatgattggctttgaaacagagttccagaaagcaggaaagtagatccacaaaatcagaaggtactcacaagggatttgtcacagttggcggcagactcatcggcaacacacgtctttgcaaagtctgttacttcctgcactaatttggcatgctcatcgtatgagcatttctggagatactgggaaaaggcaatcaggactctgaaaagcagacacaaaaacctcagtatgaggcaagtggctctcccaaccagcaaatcatgcctgtgtatacctgcgagattttgtatatctttcatacaactatctagaaagcctcttcccgtcagctattctctgaggcgtaatgggaacacctgcctttccaagcaaaggaatatggacttctaccatgctgaagtgcagatgcacatatgtgtcaatagatttatgaacatgaggcaaacaggcaaactactctctaaatttattcattgtcaaggctagatattatataagtcctttgaattgtttcttttctaaccatatacctctgttatttggaatacatgatactattgaccttctaaaaataaattaattactcatttttttactacattaaaacattactaaggttggagatgtgacttaagtatagaccccttacttcacatgtataaggtttcagtactacaaagagacaaaataatgttctcaagataccatgagatcttattgcattaaaagttagtaagtgagctgcccccaaaactatagttcatagacctttccagaaataaaaaataagattccagacttaacaagttagatgtgggctccagattctctctccaggaaaggagctactagccacacatggctagatacattcaattaaaattaactattatttgaatgtgtgcttctcagttacacttgccatgtgcaaagtgcttgatagccttgtgatctctggctgccacattgctcagcacagatccacagtctttctgtcaatgcacacatttctactggacagcactgctctacaattctcacactcaaggtggaaaaaggtgttttaaaactttaactaatactaccagaaatattaagtgggctttcagcattataacttacaggcctttgaaatgttgttctcccaaatcattataccgatgggcgatctcactcttgtctgtggaaacagggagagaaaaaccacacaacatatttaaagattgatgaagacaactaactgtaatatgctgctttttgttcttctcttcactgacctaagctactccctgaagatgccagttcccgatcgttacaggaaaatctgaaggtggcaatggttcctctctgctacactcaaagttatattttttcaccaacattattatttttaaaacccgttaagtgtttatatctgtgcattcaaactcaagatttagtgtttctgtcatgtttgtaaatatctactaagacaatggtaaataagaaataaaggtaaatataaatggaaactccatttataaaattagtaacacacacttttaatttttagtatagcatggtcgagcaggcaggccctatgagaccgtaataaattcaactgtatccaacgtaatttgagtcattctgcctagcatttttttttaattaaaagaaatttaaagctaagctttcaaaatcccccattattgtcatcaaagataccaaaaatatatcaataatataaccacctaagggttctcagatgcaaataatgacaataataacaacaacaacagtaataataatctagaaatcagcactaaaggaaaatttaactattttaaaataccaggcttccattactagaaaaatacaagcagagatgaaaaaacataaaactcttacgtgcttctcggcgaaacacacccctggaaaaagcagagccggagacgaagaggaggaggagaaaggttacccacttcattttgccagaggctagtggggttgataggaaaggtgatctgtgtgcagaaagactcgctctaatatacttctttaaccaataactgtagatcattaaccatacttacctcgcatttcattggttcctaccccattacaaaatcataccatctttgccaaaaagttgtttgactaaatcccttgcgtatgtttgccatctggagctgttcccctctaaccccacccccacccccatgcacaagactttgtccattcattaaagttatgtaaaacagcaaattttacataagagcttaatctctttgtctcccatttgagcatttcagtgtgggccttggcatggaagcatgccacatttaaaagctaagaactgaattgcataggttgttcatcccaaatatgcttttatgtacaggtaatgaagaatgtgtatgagggaggggtgggtctcattatagggcttccaagtctttctcatctttttaaagttagaatcttccataaagcacacagtgtctcaaatgtgaactgagaagaagccagagcaataaaaaacaagtgcagaggactttcagaagtcttgtgtccccaccccatgctcaggctatgtgtgaaacgggtctggagtagaatgttttcatctaacatgaacctctttctcggggtgctttagaggagacactagaacaggcactccaatgacagtgatgatggtctttgccatcgtaacatacttcctctaacaccacaggataataattagtagcagaccagttatctcacttatgagtcagtcaagactacatccaaatcaaccccatggttcctaaatatacagggactattcagtgacaagaaggagaagaggaaggaggagaagaaggaaaaggaggaagagaggaggaggaggaagaggaggaggaggagaagcattcttctttatatctggttatacaatgaaagaaatctatgtcttatgacctcatcttgtgtcctcatcttcagaaaggtgtacaaattctgtaatcaaccacaggagtcaaggcaaaatgaaggagaagggaaaagtgtttccttgcttgttttatcactcaaaagagtcctgaaatggaataacagactagcctctacacagatgaacagaatgatagatagatagatagatgatagatagatagatagatagatagatagatagatagatagatagatagatgatagatggatagggaggtaggtaggtagatagatagatagatagatagatagatagatagatagatagatagatagatagatagatagataaagtctgcccatggaataacttctactgagggtgagggtgggtggcagaattaagccaaaaccccatcctggaaaagaaaaaaagaaactaaacagaagagataattctttcttggatcaattcctctttaaacttcctagaaagagtagtcactatttatttgaagacagtagtcatgcctagtcctgtcctggtgtgggtcttgataaacataaacaagtatgtaatgcttaagtcattgaatgtatttgtattattaactcacaagtactatatagttatatgtaatattgtgtttaagtataatattgtgttattaactcaggcttttagcactctcacatgtactatgtatactatatatacttttgtttgacaattaagtaaaaaaaaaaaaaaaaatcatctatgcagccaaagcctggagagaaaagcatcagaatgaagtaggcgcttgagctggtttagtgactgatgaagctccaatacttttaagacataaattaataacaactgagcctctccttagcagtactaactcaatgccttactcgggcatgttctaattaatctttagcagccgagaattaaagtgcttaattcttgacacagtctccgtgctcacagatcatttcaactgaagagaaacacttgagcagttgcatctggtgagtaagaatttatactcttccttctgaaactcctggcactcgtcctatatgtagactctatactgagaggaatgaagccacataattattagttacttctagacatcctgtttttcaagcttttaaactcgatggttagtcagtcatcaaaagagtttggcaggagcataaatgcaaaagttaaactaaaggtttagtttctgaataaagagaaaatagctcaagtgatctttgagtgttttctcgtgcttgtgggaggactttaaaaatgaagagtagctgagatgatttgttgtttggaaagtatggtcctgtgctcgtcatctagaagggaacaacaacaacacacacactcacacacacacacacacacacactcaaacacacatacatactcacacac

SEQ ID NO: 40 - DNA, 28 bp, Artificial Sequence
  albt9649R primer
agctctcgagaatccctgcctttcctcc

SEQ ID NO: 41 - DNA, 31 bp, Artificial Sequence
  albt2842F primer
agtagtcgacgacagcagatgcctgtgatcc

SEQ ID NO: 42 - DNA, 41400 bp, Mus musculus
ctgggggtgtggagaggcaggtcccccaggctgggatgctggcccctagactagggtgctgacccctgggctggggtgctgtgtgctacctcccactgtgaaatcgctggtgctcacaattgtctcttgtaatgtatgtgatttttttaaggagaaaaagaaacttatttaagattctgaaggtgctactattttctgttgccacaggctttaaagaaactttctgaatggggcctggcccacttctctttctctcctccaaatgaggagttaaaaatgttactagcatagcccacccgtgtaatccgttgaaaaggaacaaaaggaaaaaagaaaagaaagaaaagaaaaaaaaagaaaaagaaaaaacaaaacaaaacaaaaaaatcctcctagaaaccagaagtagagagatttctgctaattctgggctttgaagcgtacgtcttttgagggggcattttgatgtggtcctccttgcttctggagggacttggttccctttagaaaacctgccctgggaaaagacttcttggttttgaggaagatccttggttagcgatgatcttggaggtggactaagtccagagccatccctgaagccaggtgactgtcccaaggtcttccctcccgggagcccaacctttcgagtgcagccaaaccttactgcttttacaacattgcacagctgtgtagaaacccgtgttctttcccataggtgcaatttgggtgggggaggaaggaacaattacaagatccccatctgtctgcccatgccacctaaacaagtcaggactccaattggattttgaagttattttaattatagaattatttttttagaagaaagatggatgtgatagtctatatttgtgtgtttctaaagttgtgtcttgtgggggaattggattccattttagttatttaatacctcactcccacccacctgcatactgcttgtgtgtcccggcctgtcccgcaagcctagttgtgctttttgttgtctgttccccgtgccccctcctgtgtctcactctgtcttcttgtcacttgatgtgcatttgctgttgttctttcgtttctgtctaaatgtcagtgtgttcaaacccccagagggttctgtttttcccattcccttctggactttaaataaatatttaaaactgagcaatggaaagacgagtctgtggtttgatgcttcttcacggtgctcaaaggcagtttctgcagaaggtgagaagatgggtggagggtgtcctgctgaagcagagatcctcactggggcttggagcttaaagctcaggacaatagaagtgctgtctgcccagaggtctgaaagtggggcgtcacagtgtaggaagaggcattctctatccaagcccctaagcctggagcagtcctgtcatggtccctcctcttccagctacactccaaactcaggggatggggctcaggggtttgcacttggtgttgaaccatacattgtttctaaattcattttgacagcgatactgttacatctcattgttctgggtcaaccctccccagaatgtttagttactacaggtgccatgagagcaaagaaaagaagtagctatacagggtgcaatttacttgggatctactacagaaatgtggtcctgggtacagcagcaccaagtgaactattgtttgggcaagaaggaaggggacgttctcgccacagggcctggttttaaagctccacataccagggctgggaagatgactcagttagtaaagactttgctgtccaagtgtgaagaccagagttcaagtcccagacccacataaaaagtcagacattgtggtacacacttgtgttttggttgttgttgttactgttttacattttgacacagaattgaagttatatatttcttacactggtacagaattttggatattgatacaggtttaatgttttcattggtggggctggagagatagctcagcggttaagagcacagattgctcttccagaggtcctgagttcaaatcccagcagccacatggtggctcacaaccatctgtaatgggttctgatgccctcttctggtatgtctgaagacagcttcagtgtactcacatatagtaaatgaataatctaaaaaaagttttcatgggtataaatctttgtatactgatataaaattcaaaattaattttgttactcttagatgggcattgtgtctgtgcaactcatttaagaacacaagacttagacccagtccttttgatagctgctattaccaaactgtttagtatgattaattaatacaagttgatagtcatgcccatattagattctaatttagctaattacaataaagtgttttcaaagttattcaaatagtaactagctaaaaataatcaatatttgacaattcagttctgctatatatagatagatggtcttcaaaggcatcagagatccacagaatatgacaggtaatgttattttataattaaaagatatttttaaaaattgaactatttttattatattcaacacaatatatatatttttatgccaatcataaaaatggtgggcatgttattaaatgaacataaatagataaatttttgtgtttctttgtttgtttgtttgttttgtttttagtagagctttaaaatcttggctcttactgtggtacaaacccaaaataagaacaatttttagacattggagttcattgtaataaggctgtatttcaatgtccctcacatcaccaaaggattttacctccatagtagctaagctaagagttgacagttctgctgcgccaaggaatgaattgtaggctcgattatttggatacagatttcctgctatggtcaaagctatttgacttgagtgattgtcatcattctcagcccacagggaacaggttacattcatttaagaaatggtgtgtgttttaagatggtctattcatgaagtcattcatcaatgaacaatggtttcaatgaacaatggttctgcttggagggtagcacagacattaggtcctcacctaagattctggttcattggctgtgatgattttgaaaagcactcatctcagaaaaagagtaacttataaggtcctcttcttcaaaattgatacaataattataaatattaagcaaaacattcagtctcactctttgttgttctcacaagccacctcccaaattaattgtctacgtttcttttggctgtataaataattttgaaatatgtaaactgttctaaaaaccatagtatagtgtaaaaacatcaaataaacaatcctactaatagagaggctgagataggagaagcatgatttcaagaccattatgtggcacacggcaagaccctgtcatgtacaaacaagcagacagtgcatatggactgtacaatattggaccaatttctcccattaccaaattagagagaccatgggatgacagccaacaaatttctaattcctcatattttgaatttcaattgactaggatatgttggtaatattttcatattaagagttattaatgaaaagtgattgttacttcctgttatttttgttgttagaggtggagttatgtttgtgtaggtttgttgaaagattactttcttgctttttctagggtgtagtttccctccttgtgttggtgttttccatctattattctttgtagggctggatttgtggaaagatattgtgtagatttggttttgtcatggaatatcttgttttctccatctatggtaattgagagttttgctgggtatagtagcctgggctggcatttgtgttctcttagggtctgtatgacatctgcccaggatcttctggctttcatagtctctggtgagaagtcaggtgtaattctgtaggtctgcctttatatgttacttgaccttattcccttactgcttttaatattctttctttgtttagtggtgttttgaatataatgtgatgggagaaatttcttttctcgtccaacctatttggagttctgtaggcttcttgtatgtttatgggcatctcttttttaggttaaggacgttttcttctataattttgttgaagatatttactggccctttaagttggggatcgtcactctcttctatacctattatccttaggtttggttttctcattgtgtcctagatttcccggatgttttgggctaggagctttttgctttttgtgttttctttgactgttgtgtcaatgttttctatggaatcttctgcacctgagattctcccttctatctcttgtattttgttggtgatgcttgcatctatgactcctgatttctttcctaggttttctaattccagggttgtctccctttgtgatttcttaactaagcaagggaaacagaggaatgtcagcctgaagtagttatggtggacagatctccagttatcagtttgtgggatgataaatgtgcctgtgccccgcttctgctattgtgagtaacatctacacatgagagaattcataacacctgcctaggaaaggtgtgggagaaagtctcacgttactgatttgagatgcttctgtgtgctgagcaatatggacaccaactactgacataggtatacagacatcagcatggctctgagtccaagcctgcagggagagaaacaagccttgctcatctgtatgttgagaagagccaggaattcccttcagatgacagagtagcaacagggaagcttgggcacacacaacagacgtggctgctttgctaagaatagagactggggccgggggggggaggggcggtaatggatccaagctgcaatgggagcctggagccaagctgagcaggtgtcagacagcagagccaggagtacagaacagaggttggcttggggatcagaaccctgatggtgtcagtagcatctctgtggctttgtggatgagagccagcaggaagggctgcttctgatccatgggtctgtgacctggccagtttttttttttttttcccagaagaggcaggttgtagatttttctctaagccaggattcctacatttctcaatcttccgttgcacaacctaggtgttaggaagtcaccaggatggattcccctgtaggctggacttccaggaaaaggtcacttctggctgcatttgatctgtccaccatgctgcaatatcatccaaggccagttcactccaccatgcccagcagcctgtgaaaggaggagggcagacagacagacagacagacaggaagacactggaagttctaggtttagctttttgtctagggcaggatcttgggaggggtctcacttttccataaaaaaacaatgctctatgttgcctgccaacctcagggagagctatctgtccacagtaatagagcagaatagtagtctattgctgttgcacatgtgtgtatgtatgtgtgcctgtgtgtgtgtgtgtgtgtgtgtgtgtgtgtgtatgtctgtctgtctgtctgtctgtgtgtctgtgtgtgtaggctagaggcaaacctcagatatttttttcttagagcaataaaatcatatttcttaagacaaggtctctcatttggtcaggagcttgtcaagttagctagctgggtggccattgagcaccaggagtctgcccagcgacagccctccactgctgggattacagatgtgtgccaccatgtccaggcttcattatacaatctatagaggccagccacatatggttcaagccaagaatagtaccatacacgttcacagtgcaggaggtggttcccgctcaccggccacaccccttgcaccagtaaaaaatgtgttatgctttcatctcaggtgtgtgacttgagagacgtgtgcatactgtgatgagcttccagacaaggggattagagtccgcagaggtcagtcatgtggaagttgccaagatctccaaagagggtctggacttgtcccaggagtctttggggtgttttctcagccttgacccatatgttctaattagaaccagcagttctcctcattgctgccactgcaggaggttgagaatggtcctcacatcttagctgtaatgtcacttgcattccactcctgtctttctctagcacaattaacctctctgtaacagttgtttcttcatccatataatggagaactatcttactttcttgatcagcatatttttgcattttagtgccttcaaaagtggactttgaagtgtgattgacaaagccaggtctggctttctcttctttctttttgttacccctattcatctgagtgtgccattgagctgatggtgaaggttgctccgtcagtggacaaacatattacagttaggaactgatggaatctccttcacaacccagtcagtgtggtgataacaaatggagatataaagcacagagaagttaagtatattgcctaaggtcacacagggacctttcccccctctctcctttttttttccatttttattaggtatttagctcatttacatttccaatgctataccaaaagtcccccatacccacccacccccactcccctacccacccactccccctttttggccctggcgttcccctgtactggggcatataaagtttgcgtgtccaatgggcctctctttccagtgatggccgactaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggcctcggcatagtctcacaagagacagctacatctgggtcctttcgataaaatcttgcagactttaaccactgtgccagggacagatggagacacaggaaggacaagactttcagtttctaaggtgcttaagagtccctggagggcagatgcaaggtgctaggtgtccttggagaaatcacatgggtggtcagaccccaaggggcagcctaagtgaccacgatgacagcaagaaccacacaccctttctgaggaaagaaacagtattttcctcaaagtcactcttgcccatgcaggctacccattggattcctgctcttgaaccagtggagacccgtggatcagcgttctagagatcttaatgttctgaagcaaaagtgtgtaaataaagctggtattataaagtatatgtttggttgtcccacatgaaaaccaaactgcacacctgttacatatgtgtagggtgcctaggtcagccccctgcatgctctccggttggcggtgcagtctctaggagccccagtgggcccaggtgagttgattctgcaggtttccttgtggtgtccttggcctctctggctccttcaatctttcctcccctcttctaaaagattcccagagctctgcctaatgtttgtgagtctctgtatctgtttccatcagctgctgggtgaagcctctcagatgacagttgtgctaggcttgtgcctgtagaggagggattctgacgcttttatagggaatctgcatgtactgacgctgaaggtccttgtccccaactggctttcgatggatcaataaaaatgccagcggctaatggatgggaaaagggagacagggtgggacccttagaattgctcaggctaagacgcagggagagaggaggtcgttgtacttgcgggggagagagatggaacagactcagagcttcagggaagatcatctaaaacatagacagaagggaaagcgacccatgaaagggcagctcagaagtgtcttgggcagcaaagaccaatgggcatcacagaaggtaatcaagcagttaaaggtagatttggaaggtgtttagccaggagtactggaggtaaggatacgctagccttgggaggcttagaagtgcccagccactgagccagtaaagcatgttaaagacaagctaattcctgtgtgtctttcatccaaggatccaaagagaccctgagcagatggctgatagtgcagccttcccaggatcatatgtggggtagctaaaaactacatgctatacctgtctgcaagtataggtgaatatccttaacagtgccagggtgggctttctctcctggcatgggtctcaagttgggccagtcatccgttggccattcccctaattttggctccctctttatccacagacattttgtaggcagaaaaaaaatcatgggtggaaggttttatggttgagttggtgtccccatccctccattgggaatcttgactggttacaggagctgaccattcagggcctctagcactaggagcaggggctgattctgactctcttgcctgcctttggatccctttccctcaactgggctgcctagtctaacctcaataaaagaacatgacctactcccactgcaattggatatgccaggccaggttggtatccgtcagaggtctcctctttctgaagagaaagcaagggggttgggaggagaggagggagaagatgatccacagggtcaggatgtaaggtgaatgaatgaatgaatgaatgaatgaatgaaaacaaacaaaaaattaaagtatgcatttggagtgttaatatcatgcatcatatcttgtccttaagttttgtacaactagaaactatttccaaggctagtgctcaggtttcggttgtcagtgtcaggaatctcctttgtgtgtcctcagcctgagagtgtgacagccacagtcaagccggttctcagcatgttgcataaattcctggtctcaactctggaaaatttccacagcctactttgtaagaacatggacttttgtcattacctgaagcaagagcccttcctgaaacagtccattgtgtttatgcaaagcaggaggaatcagagtctaatccacttgccctgtcttacctctaggctctctcaaacctcctccacgccctgaagccactttggaagtcacatgttgaccacaggcaaatcactcccctgtggcagtactgagagattagactacacactttgctatcagaaacagccttccatagatgaacgaacgtaaatgttgtctaacaaagctgccagtgtgtaccagtacaggtgtgtgtgtgtgtgtgtgtgtgtgtgtgtgtgtgtgtgtgtgtgtgtgtgtataagagagagaacagagacagagagaggcacaaacagagagattatgatatctggcgcactgctaacttgggacagaacatatcattggtgcttttggactcctcatggttatgctttttctgctctgagaagagattaaactttcttaagactgtatagatacaacaaaacacatatgttttgggtctccagctcagcaagttctcctaggccctgtacagcccactccacggcagggggctctcaggaccatctgtggccccttccttttgccctaggtgatcactgtcaatgactttgattaatatcattaccaattagtctggagcctctagaacgcccagtaaaccaggctcaatacaaccccacctctgggcgatctgctggcaataatgttgtcgagctgcatttgtatggtcaaatctatcagttgttcatttctctctgttgctaagcaacaccatctttgcatgaaatgtcacaacccatttctcatttttctggtaataggcacttaagagcttggagtttgtggctactttgaataatgtcattagaaacatttacacacatgatactggaggtgactcatgtgttgttttgttttcatttctgttggtagactaatttttaaaggcaatatgttgctctgacacatatcagaaaaggaaacacacaatagaaatgccacaggttaaagaggggttgtaatgaaattagaacacagtaagtgaatgacaagttatgtatcattaaaacataaccctgactacactgaaacatgagaacttgtggaggacacaggaaatagatcatgaaactgtgagcgtgttctaacatgtttgctgtattgatgttttgaagcagctcactgtaatctcaagctcccagcaacgtctctgtgcctcagcaggagtcaccaggcctgtccctgcaatacttttcgagagtgttcattatgtagacaaagatcaggcaggaatgagaaccagatattttctggatgatgggcacagaccctggattgggcacacactgtcctaggcagatcctttcctgctgtagatactgggagctttgctgaactagatgtttatctcagattcacccctttgctgggcacttggctgccttcagggctgggaagaagtccccaggaacatcacactcctttggaaactaatccatctgtgttcttggccctgaacttgagcccctaagtgtcttctaagttcactatgaaccctgacttggggctccttcatagcacccttgggaggttgatgtatgtgtaggtttcactcctgctaggcagctccatgggataaaagaggggtgggaccactgtctgggacctaagtatcatcaggctagcgatgtacataccttgaccatgaatcagccactctggtgtacggcaggagcctgtgtcaggaccagtaggttgagggagctgcataaagctggcttgagggaacattttgcgcaagacatttcccaagtgctggtgagattgtgccacagctctactgtccctggcttcagtcccatgccctccccacatcgtgtcataaatgttgctgcaccatccaaacaccaatgatcttttcccaggcctggtggctctgagtgccctcagcatggcgctgcacacggttcttatcatattgagccttctgccgatgttggaagctcagaacccagaacatgccaacttcaccataggcgaacctatcaccaatgagaccctgagctgggtaagtgcctgccccgggcctggacctgttcactgtaggaggctactctttcctctgggctttcccttccctgatgtctgtgctcatctctgtgctcctggtaatgcccttgcctctcctggagacctggtggcatctccctgcctccaaactccgaagcatcactctgaggtctctcagcaagggacagagcagtaggatggctgatttttgagttgcccatgggattctggtctggagcttcagtttacccatgtatggttcagaagtcattgcttgcctgccactaatcaagacttgctaacaaggtacatattacaagccctgctcatctgtttgcctgcttctccccagctctctgacaaatggtttttcatgggtgcagctttcagaaaactcgagtacaggcaggcaattcaaacaatgcagagtgaatttttttaccttaccaccaacttgataaacgacacaatagagcttcgggagtctcaaacaatgtgagtacttgaaacagccagtccacccaccccagtccttaactacactcctggatgcctagagacctgaacaaactggctctgcctggcatccccacccaccttcaggaatggggacagctgtcttgtctacttgcctcttgccccttccctaccctggcctggtcagatcacctcttcctcagttgtccactttcttttctctttagaggtgaccagtgtgtctataactccacccatctaggattccagagagaaaatgggaccttctccaagtatggtgagggtgtgaaacactgctttctgagagggtattgccagggtctgatggggcagcagaacagggcagtttttctgtgaagtcactctctgaggcttgtaagtggaagcagatttcaacccaaagtccagctcccaggccagacttgctttggccattcttatgatcttttgtgagctcagaggggaaacccatgggttgggaagccagtgacttcagccacacacccatgtcaccagcgacagcatgtaggagggcaacccaatgctagtgagccagatcagacactcttatgttttaattgtccctgagcagaagttttaatgtttaagaggaagtgtaaactatgccccaccaccacaccaccaagggccctttccaaggccccagccatcccataactacgaagaatgagaagtgaggcttgcattcagcagagtctgaaaacatggcagccccaggcacttgcccatagctatgtgcttccttcccttggggataagactacagcatcattctagtgactcacaaagaccttcctcctgcagaaggaggagtagaaacctttgcccaccttatagtgctgaggaaacatggggccttcatgcttgcctttgacctcaaggatgagaagaaacggggactgtccctctatggtaagcacctcagagctgaggtccacaattgcactgggccttactcttggtcacccaccaacatccccacccctacctggcctcccttctgctagactgatacccaataaaccatactcccttctccattgcagccaaaaggccagatatcaccccggagctgcaggaagtattccagaaggctgtcacacacgtgggcatggatgaatcagaaatcatatttgtcgactggaaaaaggtaaatgaggaggctgtacgataccaccccagcagtgctcccagtgtcagtgaccctagaggctcagagagggcaagcttctggttaaggcagctcagcgaggcaggtatcttgttaagaactctcctgcctactgtgacagctgagatcacagaaatcctagatgggcagtgagcctgaggtgggtgaggttaagtaggaggtcctggaaagcttttagagaataagggaaagaccaggagtggggactgtgggaatatccggtgccagggtgccaagtttctctctgcccttcatattcactacctatccaagcaggagttatgatttacgacttccatgacacctcaactccagcaagtctgatggctttgataggcagggatgacccatgccgaaacctcttgatgttcagtctaaccttgtgctgagggagaggccacatcagctttggctttcacccaggcaaagccatggaatcaaccaatcagcttgcatgtagtttgagatacgcaatacttttgtaacttcattccctggtcacctgagcctttcctggtatcaccagccacaggattccccgggggaggtgcctacatacagacactgccattgagctatttcacaccctgaattccttaccccccacaagcagtggggccagtagaatcacccttcacctgtggacagaagtatcggaaaatgcctgccatttgggggagctgctcacactcaatggggtgaataaaccggatctcagagatgaggaacaacttaccctagactagtggttctctaggatgggtctcaacctgtatgtcagatgtcctgcaggtcatatacttaagatttataacagtagcttaatcacagttatgaagtagcaatgaaaaccctgttgggggtcaccccaacacaagaaactgtgttaaagtttcacattattaggaaggctgagaaccactgttctgccactgcagggagccatggtagatctaagacagagctggttgacagagctagttgacactaccatgccactgtggccaacaacagtgtttacaccccacacccacattaaaatatgtgtatacattgctagtgtgtgtgtgtgtgtgcgcgtgtgcgcgcacacgcgtgcgtgcgtacgtggatatgtgtgtgcatttgagtgagtgtgtgcatgagtgtgtgcatttgtgtgagtgtgagtgtatgtgtgtgcatgtgtatgcatgtgagttcatgtgtgagtgtgtgtgcatgtgtgactgtgtgggtacacaagcatgctataagacatgtgtggatgccagaggacacctgtgggctatgtcctcttctaccattctctcctgggctctggttaaggctggatgaacttcaagctgcccctcaggcttacctaccttgccaggtttttttcttctgtcctgttcaatttggttttgtttttgcatctaactttccattccaggctaccctgaaactcatagcaatcctcctgcctcagtattcagcatcccaggcttctgccaccacccctggggtactcactctgctctcctccctgatatcttccaggataggtgcggtcagcaggagaagaagcagcttgagttggggaaggagaccaagaaagatcctgaggaaggccaggcatgaactcagctctctgaactctgagggctgtccacaggctcaccaaaccccaccccctcctgtgcactttgattctgtctctgcaacaataaaggtttgctgaaacagttaatatcatatctttgctcccttcttttcccttacttcctccctccctccatccttccatctcaccctccttctctccctccctacctggagaggcctgaatggagccttagctaagtccaagaagccctgcttggcaatctgagagggcttcctggaaggggcatctgagccaggcttgaaggaagtgaccgaacacaatgctcttgcttgtatccccaaacaatttagggcacagttggggaagacaaggcaggagacccaagtagcagtgagtgggggagggggaacataggtgaacagttcttgtcacaggtgtcttcacttcagaagtgccactctaatcactggaaaaaaagtaactaaggaggaaagagggttcatgtcgatgctaacacagccactgtataaaaggccaaggctatgcagtacagtagatagacctcgtctagagggactggatgttcccaggaagactcctcagggtgcccatgcgggacactgtgagatgacactgcttccctagacgccagctgacatcaattgcacaattgtgaccggagttcctgaggcacagtccactcggtggcaaagacagtgtctgagatcatctttacacttgactggattggcactcccctaggggatgtactccatgtgtgtctatgaggacatttccagagagccaccaccctgactgtaggcagcaccattcctcgggctgggatcccccacttaatcataagtagaaaacaagttgagcaccacaaatcatctctacctgctaagcttatggctgtcccgactggatgaggtgtgtcattgtggactgtgtccttcctcacacaggagcccaccattttgagcttttgtcaatctttctcacagaacctggaaaggtacctgatgcagagccctgctctgtctgtcaatgcactggggcagagtgagtcacagccactgccacacgcatgcccagagtcaagctgaccacacgcatagtgtgctatggaagtctctggaaggagactctggcctggggctttgtcacacacttcctgctgagtgtcccccactgtttctggcctgggaattcacacaggccttgctcatctggcctctgcaggcaaaggacaggagaagcaggggagacagatgtgagcagaagcctaggcagactctggaatgatatgcagcaagtcccctgggggagaccttagctgggtgtccacttccctgcctgcaccctcaccttagaaaccccaggctctggatacacagcacagccacaggtagctttgaagacttcttctccctttcttaagttcattatttttcttcattagctcttataacaaaaatagatttttaagtgtgccagaatgtgagtgtgtgagtatatgtgtgtgtgttagtgaaatagatcatgacactgtgagcgtgttctaacacgtttgctgtattgatgttttgaagcagctcactgtaatctcaagctcccagcaatgtctctgtgcctcagcgggagtcaccaggcctgtccctggcaatacttttcgagagtgtccattatgtagacagagatcaggcaggaagtagaaccagatattgactggatgctgggcacagaccctgagtggggcacacactgtcctaggcagatcctttcctgctgtagatactgggagctttgctgaactagatgttcatctcagattcacaacactttgttgagcacttggctgcctctaggctgcgtaagggtccccaggaacatcacaatcctttgaaaattaaaccatctttgttcttggccctcaacttgggcccctaagtgtcttctaagttcactaagaacactgacctggaagcctttcttatcacctttgggaggttgatgtatgtgtagttttcactcctgctaggcagcttcatggcataagagagggatgggacccctgtccgggacctaagtatcatcaggcttgccgtgtaccccccttgaccatgaatcagccacactggtgtaggaaaggagcctttgtcgtgacctgcggtctgagggagctgcacaaagctgacttgagggatcattttgtgcaagacatttaccaagttctggtgagtttgtgccatagctctacagtccctggctgcagtcccataccctccccacatcctgttataaaagccactgcatcctccaggtaccagttatctcttcccaagactggtgcctctgagtgccctcagcatggggctacacacagttcttgtgattttgagcctcctgctgctgttggaagctcagaacccaggacatgccaacatcaacataggcaaacctatcaacactgagaccctgagctgggtaagtgcctgcccagggcatggacctgagcactgtaggaggctactctttcctctgggctttcccttccctgatgtctatattcagctctgggctcttgttactgcccttccctttcctggagaccctggtggcatccccctgtctccaaacccagaaatatcactgaggtctctaagcaggggacaaagcagtaggatggctgatttttgagttgcccatttgagcttcagtcttcccatgtatggctcagaagtaattgcttgcttggccctcatcacggctgactgccaatgtccatactacaagccctgctcatctttgtgcctgcttctccccagctctctgataaatggtttctcattggtgcggctgtccgaaatcctaaggcccggcaggcacttcaaaagaagccaacagtatttttttacattacccacagcatgaggaacacaatgaattttctggagtatcacaccatgtgagtccttctaactgccagcccaccctttacctggcctccatgccttgatgcctagagacctgagcaaactggctctgcctggcttccccacgcaccttcaggaatggggacagctgtcttggctacctgcctgttgccccttcgctaacccaggatagtcagatcacctctccatcagttgtccactctctctttgctttttagaggtgaccagtgtgaaacttacaccacccatctgaaattccagagaaagaatgggaccttctccaagaatggtgagggtgggaactcacagctttctggcagggtattgcaactttacaaggaggcagcagaacaggcaggccagttaggtctgtgaaatcacactctgaggcttgtaagtggaaggagatttcaaaccggagtccagctgccaggacagacttgctatgaccattcgtttttgaacctttgtgagctcagaggggaaacccatgggtttggaagccagtgacttcacccccccacaccccccaccccctgtccttgtcatcagcgacagcactgaggaagaaaactgaatgctggtgggacagatcagccactcttatgttttaattgtaccaaagcaaatgttttaatatttaaggagaagtgttaactatgccccaccaccacaccaccaagggtcctttccaagtccccagcaggaccatatttataaagaatgggaattgaggctttgacccaacagaggctgaacacatggcagccacagggagcctcaggcacttgtccatagctatgtgcttccttcccttggggatggggaccacagcatcattctagtgactcacaaaggccttcgtcctgcataagaaggaggagataccattgcccacctgatagtgctgaagaaacatggggccttcatgtttgccttttacctgaagaatgagaagaaacggagactttacctcagcggtagggccctctcagccctcgtcccaagccccactgggccttccttactcttggtcacccacccacagcccacattcctacctggcctcccatctactggaccctttcccagcacaaccctggatcccttcttcctcgcagctaaaaagccagatatcaccccggagcagcggaaagtattcctgaaggctgccaaacacatgggcatggataaatcaaaaatcatatttttcgactggaaaaaggtaaatgaggaggctgtacgataccaccccagcagtgatcccagtgtcagtgaccctagaggctcagagagggcaagcttctggttaaggcagctcagcaaggcaggtatcctgctgttaataactctcctgcctactgtgagagctgagatcacagagatcctagatgagcagtgagcctgaagaaggtgaggttaagtaggaggtcctggaaagcttgtggagcataagaggaagaccaggaggggtcaatgagggaacagccggtgccagggtcctaggtttgtccctgcccttcatattcactccctatccaagcaggagttttgattgacttcttccatgctacgccaactccagcaagcccgatggctttgataggcagggttgacccacactgagactccttgatgtccggtctacactcgtgctgagggaaaggccacatcagtttcgtttttcacccaggcgaagccatgggatcaaacagtcaccttgcatgtagttcaagatactcaatgcttttgtaacttcattctctggtcacctgagcctttccttgcatcgccaacccccagattcccatggggaggggcctgtatacagacactgccattgagccatttcacagcatgacttcctcaccccccaaccagtggggccagtagactcactctgcacctgtggacacaagtgttccgaaaatgcctcccgtttgcggtattctgttcgcattcaatggggtgaataaaccggagctcagagatgaggaacaacttaccctagactagtggttctcaagggtgggtctcaacctgtatgtcagatgtcctgcatgtcatatacttacgatttataacagtagccaaaccacagttatgaagtagcaatgaaaacatgattgggggtcaccacaacacaaaaaacatgtaaagtttcacattattagaaaggctaggagaaccactgttctgccactgcagggggccatggtagatctaaggcacagctggttgacactaccgtgccattgtggccaacaactgtgtttaccccccacactcattttaaaatatgtgtattcattgctggtgtgtgtgaatgtgtgtatgtgtgagagtgtgtgtatatgtgcatgtttctgagtgtgtatgtgtgtgcatgtgtgtgtgtgcatgtgtctgtgcattttgtgagtgtctatgtgtacatgtgttgcaaggtgtgcttgtgtgtgagtgtatgtgcacaaacttaccataagacatgtgtggatgtcaaaggacagctgtgggctatgtcctcttctaccattctatcatgggctctggttaaggctggttgaacttcaagctgccactcaggcttacctaccttgccaagattattgtttggcctatttgttctattttgatttgttattgcatctaaccttgcagcccaggctaccatgctgcaactcatagcaatcctccagcctcagtattcctgaacccagtcatgtgccaccacccactctgctctcctccctgatatcatctagaatagatgcagtcagtagaagaagaagcagcttgagctggagaaggagaccaagaaagatcctgaggaaggccaggcatgaactcagctctctgaactccgagggctgtccacaggctcaccaaaccccacccgtcctgtgcactttgattctgtctctgcaacaataaaggtttgctgacacagtcaatatcatttctttgcttctttcctttttctccttccctccctcccttcgtggagagtcctgagttgagccttagctaagtccaataaaccctgcccagggaatctaagagggcttcctggaagtggcatctgagtcaggctagaaggaactgacagaacctgatgctcttcctagaatcccctaatactttagggcacagtgggggaggggaacgaaggtgtacagttcctgtcacagggccttcacttcagaggggccactctaatcactgaaagggaagtgactagaagggaggaaggttcatgtccatgctaacagggtcacagtataaaaagccaaagctaggcgacatggtagacttaggcctagattagacagtctgaatgtccccacgaagactcctcagggtgccaatgggggacactgtgagatgacactgcttccctagaggccagctgacatcgattgcacaattgtgaccggagttccttaggcacagtccactcggtggcaaagacagggtctgagatcatctttacacttgactggattggcagtcgcctaggggatgtactccatgtgtgtctgtgaggacatttccagagagccgccaccctgactgtaggcaatgacattcctcgggctgggatcccccacttaaccaaaagcagaaaacaagctgagcatccacagatcatctctgcctgctaagcttatggctgtcccgactggatgcagtgtgacatggtagactgtgtccctcctcacctctgatctccccattgttagcttcttgtcacttattttgttacagaacctggaaagacacctgatgcagcgccctgctctgtctgtcaatgcactggggcagagtgagtcacagtcgctgccacacgcatgcccagagtcaagctagccacaagcatagggtgccatggaagtctctggaaggagactctggcctggggctttgtcacacacttcctgctgagtgtctcccactgtttctggcctgggaattcatgacaggccttgctcatctggcctctgcaggcaaaggacaggagaagcaggggagacagatgtgagcagaagcctaggcagactctggaatgatatgcagcaagtcccctgggggagaccttagctgggtgtccacttccctgcctgcaccctcaccttagaaaccccaggctctggatacacagcacagccacaggtagctttgaagacttcttctccctttcttaagttcattatttttcttcattagctcttataacaaaaatagatttttaagtctgccagtgtttgagtgtgtgagtatttgtgtggattttcctgaaatagatcaggacactgtgagcgtgttctaacacgtttgctgtattgatgttttgaggcagctcactgtaatctcaagctcccagcaatgactctgtgcctcagcgggagtcaccaggcctgtccctgcaattcttctagagagtgttcattatgtagacaaagatcaggctatatctatcagggaggaagtagaaccagatattgactggatgctgggcacagaccctgagtggggcacatactatcctaggcagatcctttcctgctgtagatactgggagctttgctgaactagatgttcaagtcagaatcaaccctttttgggcatttggctgcctctaggctgggaaggggtcctcaggaacatcacactcctttggaaactaatccatctttgtccttgggccttaacttgagcccctaagtgtcttctatgttcactatgaacttgacctgggaccccttcttatcacgcttgggggcgggttgatgtatgtgtaggtttcactcctgctaggcagcttcatgggataagagaggggtgggaccgacccttgtctgggacctaagtatcatcaggctagccctgtacccaccttgatcatgaatcagccactctggtgtagggcaggagcctgtgtcacagccagctggctgagagagctgcacaaagctggcttgagggaacattttgcacaagacatttatcaagtgctggtgagtttgtggcactcactgctctacagcccctggctgcagtcccatgccctccccacatcctgttataaaagccactgcaccctccagccaccagttatctcttcccagctctggtgcctctgagtatcctcagcatggaactacacacggttctcatcatgttgagcctcctgccactgttggaagctcagaacccagagcatgccatcaacataggcgaccctatcaccaatgagaccctgagctgggtaagtgtctgcccggggcctggacctgttcactgtaggattctactctttcctctgggctttcccttccctggtgtctgtgttcagctctgggctcctggtactgcccttcccacttgtgtataccctggtggcatccccctgtctccaaaggcagaatcatcactctgagccatagcttgcctgcccctcatcgtggatgaatgccaaggtcctcactacaaggcctgctcatctgtgtgcctgcttctccccagctatctggcaaatggtttttcattgctgcggctgactcagaccctgattataggcaggaaattcaaaaggtacagactatatttttttaccttaccctaaacttgataaatgacacgatggagcttcgagagtatcataccaagtgagtccttgtaacatccagcccaccctggccctggcttccactcccagatgcctagagacctgagcaaactggctctgcctggcctccccacccactttcagaaatggggacagctgtcttgcctcttgcccccttcctaccctgggctagtcagatcacctctccatcagttgtcctctctctttgctttttagagatgaccactgtgtctataactccaaccttctgggattccagagagagaatgggaccctcttcaagtatggtgaaggtgtgaactcactgctttctgggagggtattgccagttctgaggggacagcagaacagggcagtttggtctgtgaagtcactctctggggcttgtaagtggacgtagatttcaaactggagtccagctgccaggacagacttgttttgatcattctttatgacccttcgtgacctcagagtggaaagccatgggttgggaaaccagtgactttagccacacccccaggtcaccagggacagcatggaggagaaccacccaatgctggtgggccagatcagacactggttagcttttaattgtccctaagcagatgttttgatgtttaaggggaagtgttaactatgccccaccaccacaccaccaagggccctttccaaggccccagctcttccatacctatgaagaatgagaagtgaggcttgcatccagcagaggctgagcacatggcagcctcagggagccccaggcacttgcccatagctatgtgcttccttcccttggggatgtgaaccacagcatcattctagtgactcacaaagaccttcctccaacagaaggagaagtagaaacccttctccacctgagagtgctagagaaacatggggccatcatgcttttctttgacctgaaggatgagaagaaacggggactgtccctgagcggtagggtcctctcatccctggtccccagctcaactgggccttactcttggtcacccacccacatcccacatccctacctggcctcccatctactggacccatagccagcataactttggatcccttctcccatgcagctagaaggccagatatccccccggagctgcgggaagtatttcagaaggctgtcacacacgtgggcatggatgaatcagaaatcatatttgtcgactggaaaaaggtaaatgaggaggctgtacgatacgaccccagcagtgctcccagtgtcagtgaccctagaggctcagagagggcaagcttctggttaaggcagctcagcgaggcaggtatcttgttaactctcctgcctcctgtgagagctgagagtcacagagatcctagatgggcagtgagcctgaagaaggtgaggttaagtaggagattctagaaagcttgtggaggataagaggaagaccaggaggggtcactgagggaacagccggtgccaggatcccaggtttcttcctgtccttcatattcactaccttttcaagcaggagttttgattgacatcttccatgtcaccccaactccagcaagcccgatggctttgataggcagggttgacccacactgagactccttgatgtccggtctacacttgtgctgagggagaggcgacatcagttttgtttttcacccaggcgaagccatgggatcaaacagtcaccttgcatgtagtttaagatactcaatgcttttgtaacttcattctctggtcacctgagcctttcctggcatcaccagccccaggattccccgggagaggtgcctgcacacagacactgccattgagccatttcacagcatgacttccccaccccacaaccagtggggccagtagactcatcctgcacctgtggacagaagtgtttagataatgcctgccctttgggggattctgctcacaatcaatggggtgaataagccggagctcagagatgagggacaacttaccctagactagtggttctctaggatgggtctcaacctgtatgtcagatgtcctgcacgtcaggtatttatgatttataatagtagactaattacagttatgaagtagcaatgaaatcatggtcggtgatcaccacaacacaagaaactgtgttaaagttttgcattattaggaaggctgagaaccactgtcctgccactgcagggagccatggcagatctaagacacatctggttgacactaccgtgccattgtgaccaacaacagtactccccccaacccaccttacaataggtgtattcatagctagtgtgtgtgcatgtgtgactgtgtgggtacacaagcatgctataagacatgtgtggatgtcagaggacacctgtgggctatgtcctcttctaccattctctcctgggctctggttaaggctgggttggcttcaagctgcccctcaggcttacctaccttgccatttttttttgttgttctgtcctgttttttctgttttgttttgtttttgtatttaatcttgcagcccaggctactctactgcaactcatagcaatcctcttgcctcagtattcatcaaccctggtgtgtgccaccagccctggcttactcactctgctctcctccctgatatcttccaggacaggtgcagtgaacaggaaaagaagcatcttgagttggagaaggagaccaagaaagatcctgaggaaagccaggcatgaactcagctctctggtctccttgggctgtccctatgtgcaccacaccctaccccatcttgtgcactttgattctgtctctgtaacaataaaggtttgctgacactgtcaatatcatttctttgctcccttccttttcctccctccctccctcccttcgtggagagtcttgagtggagccttagctaagtccaataacccctgcccagggaatctgagagggcttcctggaaggggcatctgaatcagggtagaaggaactgacagaacccgatgctcttgctagaatccccaaacactttagggcatggatggggaagatgaggcaggagacccaagcagcagtgagaaggtgtggggaacgcaggtgtccagttcctggcacaggtgccttcacttcagaagtgccactctaaccactgaaagacaggtgacttgggagacaggagggttcatgtagatgctaacacgatcaagctttaaaaggctaaggctaggtgtcttggtatacttaggccttgactaaagggcctggaagtctccatgaagattcctcagtgtcccatgggggacactgtgagatgacactgcttccctagaggccagctgacatcaattgcacaattgtgacaggagatcctgaggcacagtccactcggtggcaaagacagggtctgagatcatctttacacttgactggattggcagtcccctaggggatgtactccatgtgtgtctgtgaggacatttccagagagccaccaccctgactgtaggcaatgacattccttgggctgggctggggtctcccacttaaccaaaagcagaaaacaagctgagcatccatagatcacctctgcctgctaagcttatggctgtcccaactggatgcagtgtgacatggtggattgtgtcctcttcacccatgatggcctatcattagcttttgtcaggtttttgtttgtttgtttggttgattggttgtttggttgtttggttggttggttggttggttggtttttttgttttttgtttgtttttttggtttttttttttttttttttttttggtcacagaaccgggaaaggcacctgatgtagcgccctgctctgtctgtcaatgcactggggcagagtgagtcacagccactgccacacccatgcccagagtcaagctgaccacacgcatagtgtgctatggaagtctctggaaggagactctggcctggggctttgtcacacacttcctgctgagtgtcccccactgtttctggcctgggaattcatgacaggccttgctcatctggcctctgcaggcaaaggacaggagaagcaggggaggcagatgtgagcagaagcctaggcagactctggaatgatatgcagcaagtcccctgggggagaccttagctgggtgtccacttccctgcctgcaccctcaccttagaaaccccaggctctggatacacagcacagccacaggtagctttgaagacttcttctccctttcttaagttcattattttccatcatttgcttttataacaaaaatagatatttatatctgccagtgtgtgcaaatgtgtttatgtgcacgtgtacgtgtgcgcctgtgtgtaagagacatagcagagacaaagaggcacaaacagagagattatgatatctggcgcactgctaacttgggacagaacatatcattggtgcttttgggctcctcatggttatgctttttctcctctgggaagagataaactttcttaagactgtatagatacaacaaaacacatatgttttgggtctccagctcagcaagttctcctaggccctgtacagcccactccacggcagggggctctcaggaccatctgtggccccttccttttgccctaggtgatcactgtcactaacttgattaatatcattacaattagtctggagcctctagaacgccctgtaaacaggctcatacaaccccatctctgggcgatctgctggcaataatgttgtcgagctgcatttgtatggtcaaatctatcagtcgttcatttctctctgttgctaagcaacaccatgcttgcatgaaatgtcacaacccatttctcattttcctggtggtaggcacttaagagcttggggtttgtggctactttgaataatgccattagaaacatttatacacatgatactggaggtgattcatgtcttgttttgttttcttttctgttggtagactaatttttaaaggcaatatgttgctctaatacttatcaagaggggaaacataaaatacaaaatgccacaggataaaagaaggttctcatgaaattagaacacagtaagtgaatgacaagttatttatcattaaaacaaaaaccctgactacacagaaacatgagaaatagtagattactcaactgtgagtgtgttctaatatgtttggtgcttttgatgttttgaaagagctcactgtgatctcaaactcctagcaatgactccgtgcctcagcaagagtcaccaggcctgtccctagcaatacgtttcgagagtgttcattatgtagacaaagatcaggctatatctatcaagcaggaactagaaccagatatttactggatcctgtgcacagaccctggattgggcacacactattctagacagatcctttcctgctgtaaatactgggagctttgctgaactacattttcaactcagattcacccctcttttttgggcattcggctgcctctaggctgtataggggtccccaggaacatcacactcctttggaaactaatccatctttgtccttggcccttaacttgagcccctaagtgtcttctaagttcactatgaaccctgaccagggaccccttcatagcccccttggaggggtgataaacgaataggtctcactcctgctaggcagcttcatgggataagacaggtatgggacccatgactgggatctaagtattatcaggctagcccagtatccaccttgaccatgaatcagccactctggtgtagggcaggagtctgtgtcagggccggctggccgagggagctgcacaaagctggcttgagagaacattttgcgcaagacatttcccaagtgctggggagaatgtgccagggctctagaggccctggctgcagtcccatgccctcgccacatctattataaaagccactgcaccctccatccaccagttatctcttccaagccctggtgcctctgagtgtcctaagcatggcactgcacatgattcttgtcatggtgagcctcctgccgctgttggaagctcagaacccagaacatgtcaacatcaccataggcgaccctatcaccaatgagaccctgagctgggtaagtgcctgcccaggacttggacgtgagcacttaaggaggctactctttcctctgggctttcccttccctgatgtctgtgctcatctctgggctcctggtactgccctttcctctcctggagaccctggtggcatccccctgtctccaaacccagaagcatcactctgaggtctctcagcatgggacagagcagtaggatggctgatttttgagttgcccatttgagcttcagtcttcccatgtatggttcagaagccattgcttgcttgccccacagcacggctgagtgcaatgttcatactacaagccctactcatctgtgtgcctgcttctccccagctctctgacaaatggtttttcattggtgcggctgtcctaaaccctgattaccggcaggaaattcaaaagacgcagatggtattttttaaccttacccccaacttgataaatgacacgatggagcttcgagagtatcacaccatgtgagttcttgtaacagccagcccaccctggccctggcctccactcccagatgcctagagacctgagcaaactggatctgcctggcctccccacccaccttctggaatggggacagctttcttgtttacctgcctcttgcccactccccaccccagtttagtcagatcacctctccatcagttgtcctctgtctctttgctttctagagatgaccactgtgtctataactccactcatctaggaatccagagagagaatgggaccctctccaagtatggtaagggttggaactcacggctttctgggagcgtattgcaagggtacaagggggcagcagaacaggggagtttggtctgtgaagtcactctctgaggcttgtaagtggacgtagatttcaaactggagtccagctgccaggacagacttgctttgaccattcttatgatcttttgtgagctcagaggggaaacccatagtttgggaaaccagtgacttcagccaaatccccaggtcaccagcgacagcatgggggggagggcaactgaatactggtgggccagattagatactcttaggttttaattgtccctaagccaatgttttaatgtttaaggggaagtgttaactatgccacaccaccaagggccctttccaaggccccagccattccatacttatgaagaatgagaagtgaggctgcatccaacagaggctgagcacatggcagccacagggagcctcaggcacttgtccatagctatgtgcttccttcccttggggatggggaccacagcatcattctagtgactcacaaagcccttcatcctgcagtaggaggagtaaaaatctttgcagacctgatagtcttgaagatgcatggggccttcatgcttgcctttgacttgaaggatgagaagaaacggggactgtccctcaatggtagggtcctcccagacctggtccccagctccactggccttactcttgatcgtccacccacatcccacatccctacctggcttcccatctgctggacccttagccagcacaatcctggatcccttctccattgcagcaaaaaggccagatatcaccccggagctgcgggaagtattccagaaggctgtcacacacgtgggcatggatgaatcagaaatcatatttgttgactggaaaaaggtaaatgaagttgctgtacgataccaccccagcagtgctcccattgtcagtgaccctagcagctcagagagggcaagcttccggttaaggcagctcagcaaggcaggtatcctgctgttaataactctcctgcctactgtgagagctgagatcacagagatcctagatgggcagtgagcctcagggaggtgaagttaagtaggaggtcctggaaagcttgtggaggataagaggaagatcaggaggggtcacttagggaacagccagtgccagggtgccaggtttctcccttcatattcactacctatcgaagcaggagtcgtgattgaagtttccatgccacccaactccaacaagcccaatcacaggcggggatgacccatgcggaaacctcttgatgttctgtctaaccttgtgctgagggagaggccaaataaactttggctttcaccctggtaaagccgtgggatcaaccaatcagcttgcatgtagtctgagatacacaatacttttgtgactccattctctggtcacctgagcctttcctggcatcaccagccccaggattccccgggggaggggcctgcatacagacactgccattgagccatttcacagcatgacttcctcacacccccccccccccaaccagtggggccagtagactcactctgcacctgtggacacaagtgttccgaaaatgcctcccgtttgcggtattctgttcacattcaatggggtgaataaaccagagctcagagatgagggacaacttaccctagactaatggttctcaagggtgggtctcagcctgtatgtcagatgtcctgcatgtcatatacttcagatttataacagtagcttaatcacagttatgaaggagcaatggaaacatggttgggggtcaccacaacacaagaaaccgtggaaaaggttcccatctctaggaaggctgagaacaacagtcctggatctgcaggggagccatggtagatgcaagatacagcgtgctgacacaaccctgcccttctggccaacctctgtgcttcccccctttagaaatgtactcatagctagtgtgtgtgtgtgtgtgtgtgtgtgtgtgtgtgtgtgtgtgtgtacacaagcttgtcataagatgtgtgtggatgtcagaggacaactgtgggcagtgttcactccagccattttctcatggactctgatgattgacttcagagcttacatactttgccagggtttttgttctgcttgtttgttctattttgttttgtttttgcatctaaccttgcagcccaggctaccctactgcaactcatagcaatcctccagcctcagtattccccaaccctagtgtgtgccaccacacctggcttactcactctgctctcctccctgatatcttccaggataggtgcagtcagcaggagaagcagcagcttgagctggagaaggagaccaagaaagatcctgaggaaggccaggcatgaactcagctctctgaactccgagggctgtccacaggctcaccaaaccccacccctcctgtgcactttgattctgtctctgccacaataaaggtttgctgacacagtcaatatcatttctttgcttctttcctttttctccctccctccctccctttgtgcagagtcctgagtggagccttagctaagtccaagaagccctgcccagggaatctaagagggcttcctggaaggagcatctgagttaggctagaaagtactgtcagaacccgatgctcttgctagaatctccaaacacttagggcacagttggggaagacaaggcaggagacccaagcagcagtgagagggggtggggaacaaaggtgtacagttcctgtcacagggccttcacttcagaggggccactataatcacaggaagggaggtgactgggaggcaggaaggtacaggttgatgctaacagggtcacagtataaaaggccaaggctaggcgacatggtagacttaggcctcagctagagggtctggatgtcccctggaagactcctcaaggtgcccatgggggacactgtgagatgacactgcttccctaaaggccagttgacatcgattgcacaattgtgaccggagttcctgaggcacagtccactcggtggcaaagacagggtctgagatcatctttacacttgactggattggcagtcccctaggggatgtacgccatgtgtgtctgtgaggacatttccagagagagccgccaccctgactgtaggcagtgacattccttgggctgggatcccccatttaaccaaaagcagaaaacaagctgagcacccataaatcatttctgcctgctaagcttatggctgtcctgactggatgcagtgtgccatggtagactgtgtcccctgagcccaccatcattagcttttttcagttattttgtcacagaaccaggaaaggcacctgatgaagcaccctgctctgtctgtcaatgcactggggcagagtgagtcacagccactgccacacccatgcccagagtcaagctgaccacacgcatagtgtgctatggaagtctctggaaggagactctggcctggggctttgtcacacacttcctgctgagtgtcccccactgtttctggcctgggaattcacacaggccttgctcatctggcctctgcaggcaaaggacaggagaagcaggggaggcagatgtgagcagaagcctaggcagactctggaatgatatgcagcaagtcccctgggggagaccttagctgggtgtccacttccctgcctgcaccctggccttagaaaccccaggctctggatacacagcacagccacaggtagctttgaagacttcttctccctttcttaagttcattattttccatcatttgcttttataacaaaaatagatttttaaaaaatgcctcaaatatataaacaatctgtgataacacacacacacacacacacacacacacacacacacacacacacacacacacacacatcccagaaatgttgaggtcactctgctatgggacagggaaacgggtaccggcctggtctatcagcctcaggccagggcctggcaaggtagcttggtcctaagtggatgccaaagacatagtgggtatgtctgaggctgctgggtgcttcctggcctacatgagcagcttctactccatgagctcatgggaaaaacttctgtaaccacagaagagctgggcgtgcgtcagctgaggcctcagccccaagacattaatgggtccccaagtactacccctgcccactagttactaggaacaaaatccctaactagttcttctccctgacaacgcctgcctcagagtagctatcacaggcagtgtccaaaatgcttcagagaccctagacttttcttttcctctctggccttctgagacaggtccaagcccaagttagctccccagtgtaaagacattctgtccagtaagagccacattattagctgcagaagcacatgggcaggagggggacgaggaggagtctcagcgactctgactcgacagagggagccatgatcactacacctgttagacagagttggcccccagacattcatccactcctgactaggccaatgtctctccattttaaatacgccacatgaatcaggtggcactcctggggaggggaacgtgacatcttccagccatcagtggtaccaggagactgttgactgggaaacaacagtggctgcctgcctacttagtctcagagtctccagggagtcagaaaaggcaggagcctcgcaggctacgggcatggcgcaggtccgcagacagggagcggctcagctggcgggtggtggagcgaacgttctcggcggcctgtgcagcctctctgagtgcggcctgcagctcctccaggtcattcagacccagttggactgagtgccgggttctccgaggtccccgagcaggctgcggggaagctgtctgggctgaggtaggtgctggggctgcatagtacctggggagagaaggaagaacatacgatctggcaagggtcaggcaaagccaccagctatgggttccatgtctactgtacaccctgctctttcctctcctgtccaaggccactgtggagaaacaaacttgggagggatgaaggagagtatatgtgtgagtgcttgccctggagcaggtgtaggcacgactagttcattccagcctctgacatagcaatcagacccccttaagtgtacactctggggctgcaatggaagtcagtatctggaacatcaatctgcagatggcaggtgttgatggaaggtgccaaaatgaacgactgggcttcctgggggtagcagagctgctcagacaccctcgttgagggagaacctgggctctctgtggcttccatccttgcagctcataggagggccagcttgatccaagccttccctgaaggcactggattagagagcctcagtcagctgcagggctgcatctggccagcaggtggcagcacagcaccactgcgattgctggttcaaccatggtgcaagcttagtcctgctgcccagacagaagaaaaccaaggtatggcttgttctaacaagacctgaaggcttgatgaagccatggcttcccatatattcacctaatcatctcgagtatctgtttctcagaagaagaaacagaccagagagacaaagtgatgagcccaaagtcattctccaagtgctgtccactcaattgtcccttccttggggccaccacactgtggtgagctcccccccgccccccaggcccagattgtaaagatttgtcttgagacaagtagagaatgctgaggctaccatagggttgctaaaggacatcaaacctccccagcccgaggacaggaaatgtgggcaggtgtccataccacgtgagccagggtctggacacgaagaaaggctggccctagggacccaccaggactcaagcaagaaggcagaagaaaatgtacctcaggcctgacccctcatgcctgctggtgccttgggcttctcttctgctggcatcagctgctacagagccaactactaccccattaatcacagaggctgtctattggtaacactgcagcccaacaggcccactttacagtggaggaaactgaggctaagactagaaaggggcttggggggggtggctaatgttccatttagtcagtcatgacacttcctggagtcacaagacagactccacacatatcccagtggggtctgacagtgtctcacttaatcctcacacatcaggacctagcagagtcacttcctcattgaacagatagagaaactgaggcttaaagaaacactcctctgcttccgccatagtactcataagagaggggattctggtacagccaattcctgaaatgtcaccaggctgccatgcccactctccgcctttttggtaagtgatgcttaagaccaaatccatctagctggtgcccctgcatgccaaagtcacagagacagggcagtatggagcagctgccaccaccaagaggagcccaagttgccaatgaaatgtaggggatcctggatggtgccccggaatagaatgggcatcaggcctaaaacaagcatgctagaggaaaagagcaagcttcggctaatactaaagcattccagttggttttctcctagtgacgggtttgcataggaacacagccatgggaatgggctgtgggggaggggcagtgcatgggagagctgtgtagtgtgcactcaattctcctaaatccaaaaccatcccactaatgagaattgattgaaaaaaagaagggagaaggaatagaaactatgcttactttatacacacgtgtgcacacacatacacacacaaactcacacaaacacacaccttattataggcttactcattaggaaagaaagatggcttatggttctaggtcctcaagaagctgtaactccagagacagggccctcttgctagtctagttcaccactgggtccccaagcacccagaagcctgtcccatgagagtttgttgagtgactacaagaatgtcaggcttatactccattttccatacaggaagacactacccctggctcacagcatcctgacatgatgtaagaatgctggggtggttttttgcgggtacccaggtagcatggggcagctggaaggggggactcacacagtgggtggtagataaggcataatgggagctgaggagatgtaggccaaagccggtggggctggggctgggggcgcagcagccaggtaccagagtccaggggccattcgtactggcgagcccgtctgcctgttcttccgtttgaggatgggggtggaaggctttttgggggtgttcttctctgcaagggaaggaaagacagagaaattacatgaggacttagatgcagccaagcacggtgggtcagccagctacccctgcacttgtggctgatgggcagtggaggaccaccctagggagggcatccctctgggatgttgagcctctgttgcatttattttgctctagcggagcttacagcatccccaaggtctggccaagccccgtggctgaagaaagatgctgagggctcattcctaccagagggacctgagctggagccatctgcttctgcagaggacttgacttcaccacacagggcacagcggagggtgtcagcggcagatgagccccgtgtggtgtctctagagacagcactgcctgcaagggaagagagagagggagggggaaaggtctgcagacaatgactggcactctattatcagacccgggtcccctgcagagaccacccaggccgcctgatggaggacactgcacagtaaccatgaagaggtaagcaggcactgaccacacgctagccactaatgacttaatgtatcactccacagtgcctagcagctcaccaggctagccactctccccatctcccctctatagcagaggaaacagaggctccacgaggcagtactttgccaagggaaggcccaggccatccagatgacaagcccattttgcctttgagacagcctcagtgtattcatgggagtccagaagagggaaatctgggtcagtgaaaggtcaaaggaacatttcagacatccactgtggtccctgcctgagcatcagacttgcttttcaggccactcttggccagcacatcctctgggaactgcccacagccttggtctgtgttggccctgaccactctgctttgatgctggctccttggagacaatactggtgggcactgagcaagagagtaaatgagtgaattggaaagtctgtcaggacatcgatccatggtggggaggggccagtgctccggagcataaagacctgagttcaaatgttggctctatcacttgtaaactgtgtgcctttgagcaagttactctcctctcataaaatagtctgtgttcagctctaataaaacttctcagtggggagaggcttaagcctccactgaacaaaatgctgtctcttacctgtgtcctgggtcctaatgggatggcagtggggacaggacagtgtgccactgtcctttaggatggcctttggggatagaatgtggtactcctggcctggagaagaatccagaaagatcagtgtccagacctgtgtgaactagggactggtttcattgtctctcttctctttcagtagttttactagttgctctctgcctatctcctgtgcacatgtgaaagcaaaacccacagatatacccactgcacacatgtgtgcacacagagcacagatgcctgtttgctactgccccctcctggctccttgttgcatttctgcttctagaagcagctgccagttcttgtgtgtggaagtgacggggcatgcagcagaggcaggacatggaagctggtgaggcagaagtgtcatgactagtgtcatgagtcaggagttatcactgtcccttccttgccccaggctcagttgagggatcaggagcgtctctccttgggcgctaaacagctggaaagggggacatcaaagggccaatttctggaactgtgtcaaggacagaacgggtctatattagacagccaatggaaagctctccattctatgaggtacctggctgatcccagtatggtcttaagctcctgaaattccactggacagaggtgaaaacaaacaagcaaataaaaaaacccaacaataacaaaaaacaaaaacaaaaaacccaagggctgaggctggagatgactcagtggataaagtccttacaacacccatatatttagaccagcttgtatccttagcactcctataaaaggtgggtgggtgggtacagtgaccacctagaatccaaccactcaggaggcaggggttcggcgggagagatggacacccagggcaagacagtcacctgaactacatgaattggtgagattcaggttcagtcagagatcttgcctgtagtggctgattggttttgtgtcaacttgacttgagctaaagtcatcagagaggaaggagactcaactgaggaaattcctctataaagatcatgctacaagtgagacatcttcaccattagtgattgatgggggagggcccaggccacggtgggtgctgccatccctgggctggtggtcctgggttctataagaagcaggctgagcaagccacaaggagcaagccagtaagcagcaccctccatggcctctgcatcagctcctgcctccaggatcttgccctgcgtgagttcctgccctgatttccttcctttcgtccttttttgggggatgaacagtctttcttccctaacttgcttcttggtcatggtgtttcatcacagcaacagagacccagacgaagacactgcctcagtaaataaagtggagagtgatcaagaaagacagcagactatgaggacacacaagcacatgaaccacatgcccccccccccacacacacacacggtaaatatcagccaagggctgaggatgggactccgtgattgagcgtgtgttgagtgtgcacaagctcacctgtgtattgaccccggaaggaaactctttccctccgcttcgagctgctctgtggtcttgtcccccactgtgcagcctcggagtgctcctcaaaggtcctgctcttctcagatgagagccgaggggcaggcgactccgattcagaacctgtggtgggagtggagcctcagagggggcaggtgtggggctcacgtggagggcggggctcagggcgatgcctgggctgttgatcttgagtcttctcaggggaccaagggcacctcctgaatctcagcctggagccctgtggctatcacatgcctgtgcagcaaccccaagaggtaggtgctgctatttctatgtcgtctgctgtcactttatctcctcagagcaggtgacagcctggccagggacaaactccatggctctgctctgccagtgaggaacctgcactcttcactgcggtgtcccatttgcaatggaggttggtgagcatctacacaaatcccccagtcccaaccctcatggtaacggcagagtctacatggctaggactagagatgtgctttgtcccagagcaaaacaatagcgtcaaacatacatacagaagacctctccagggcttttctaggttctcaaaccacagagccaacatactgacgaggatccctagaaaacagccctggtctctgctctctggtcacttacttaggtagagtctgggtacatcccgaggcaccgaagaggacctggctcgacgtcttcccattggctcagctggctctacaccattaggctccccagacagcctctctgtggatttactagcaacaaggaagagagatatgatgtcaccggatgagatttgggaggcagcctccacatatggccctggcatatgtgcacccttccttaaattaaatacatgtgagaagaaaagcctgagaatggaccagtggccatgctagggggaggggagagtatagtgtctgagtccctgtgcccaaagagccagagactggctaatgctatagggaacagaggtaggggttggggtggggcttctacctgccatagtgggggccccaggagggtgaggaacccagcttttcctgggtctgggtggagtggttgaaagcagaagctacacaggctgggccgtctgggtgtggccggtgcaggctgtcctccagttgaaggcggagccgtgaaacctccgcctgcagatccttgatggcctggctggagtggtgaagagacagaaacgagatcatttgagcaacgaacagagctatcgggacgccgatagctctgggtggagtggcatgtgtctgcagacacaagatcgggctgtacagtccagtaacagccttgacatcattctgagttcatattccacaagcacatctgggtaacctacctatgagggtgaccctcttagcatacgggctcagcctctcaagacagtgactacacaacactgaatcgggtttggaagctgaggcaggaggattaccatgagttccaggccagcctgggttacatagcaagaccccttcccacctcctttcagaagctgtaacggtctgagcagggctctctgctcctattcctgcagatattcttacagtctgtggttattcccagcagaagacacttgtgccctgcttttgcctcccaggccctgacccacaggcaggcaagattagcatcccactccataaccccagacacattagatgctggggagca

SEQ ID NO: 43 - DNA, 22 bp, Artificial Sequence
  AGP99R primer
tcattacaacccctctttaacc

SEQ ID NO: 44 - DNA, 22 bp, Artificial Sequence
  AGP45F primer
ggacaccaactactgacatagg

SEQ ID NO: 45 - DNA, 22 bp, Artificial Sequence
  AGP49R primer
ccacagagatgctactgacacc

SEQ ID NO: 46 - DNA, 19 bp, Artificial Sequence
  AGP12F primer
gcagaaggtgagaagatgg

SEQ ID NO: 47 - DNA, 20 bp, Artificial Sequence
  AGP339F primer
tccaaaatgcttcagagacc

SEQ ID NO: 48 - DNA, 21 bp, Artificial Sequence
  AGP403R primer
agtgaccagagagcagagacc

SEQ ID NO: 49 - DNA, 22 bp, Artificial Sequence
  AGP5'exF
gctacctcccactgtgaaatcg

SEQ ID NO: 50 - DNA, 20 bp, Artificial Sequence
  AGP5'exR primer
cacaagcagtatgcaggtgg

SEQ ID NO: 51 - DNA, 20 bp, Artificial Sequence
  AGP3'exF primer
agtctgggtacatcccgagg

SEQ ID NO: 52 - DNA, 20 bp, Artificial Sequence
  AGP3'exR primer
cagacacatgccactccacc

SEQ ID NO: 53 - DNA, 32 bp, Artificial Sequence
  Forward primer: nt 47283-47314 of SEQ ID NO: 19
caggctgcgcctgggatctctacactcgagca

SEQ ID NO: 54 - DNA, 31 bp, Artificial Sequence
  Reverse primer: reverse complement of nt 58112-58142 of SEQ ID NO : 19
ctgcacatacggaatagatggaacaactcag

SEQ ID NO: 55 - DNA, 31 bp, Artificial Sequence
  Forward primer: nt 58112-58142 of SEQ ID NO: 19
ctgagttgttccatctattccgtatgtgcag

SEQ ID NO: 56 - DNA, 27 bp, Artificial Sequence
  Reverse primer: reverse complement of nt 66131-66157 of SEQ ID NO : 19
cctttgcctatctcagaaccataaatc

SEQ ID NO: 57 - DNA, 28 bp, Artificial Sequence
  Forward primer: nt 84-111 of SEQ ID NO: 9
ctacattttcaactcagattcacccctc

SEQ ID NO: 58 - DNA, 30 bp, Artificial Sequence
  Reverse primer: reverse complement of nt 2991-3020 in SEQ ID NO: 9
atggctgctggcatgtctgtatggcaggcc

SEQ ID NO: 59 - DNA, 27 bp, Artificial Sequence
  Forward primer: nt 898-924 of SEQ ID NO: 11
tcatcgtggatgaatgccaaggtcctc

SEQ ID NO: 60 - DNA, 32 bp, Artificial Sequence
  Reverse primer: reverse complement of nt 3492-3523 of SEQ ID NO: 11
caaggtaggtaagcctgtggggcagcttgaag

SEQ ID NO: 61 - DNA, 36 bp, Artificial Sequence
  Forward primer: nt 26930-26965 of SEQ ID NO: 23
gtccaaacacttctctatgataatgcaaacagtcac

SEQ ID NO: 62 - DNA, 28 bp, Artificial Sequence
  Reverse primer: reverse complement of nt 35227-35254 of SEQ ID NO : 23
gttgctctttgctgggctatgtgcatgg

SEQ ID NO: 63 - DNA, 27 bp, Artificial Sequence
  Forward primer: nt 54-80 of SEQ ID NO: 24
acagagctgaaaggaagactcagagga

SEQ ID NO: 64 - DNA, 27 bp, Artificial Sequence
  Reverse primer: reverse complement of nt 2738-2764 of SEQ ID NO: 24
gaccaatcgactgttttttattaagtg

SEQ ID NO: 65 - DNA, 75798 bp, Mus musculus
ctagctgctacttaaaatcacctggacatctttttaatgcccccacccgacccccagggaccatgcccaggctctagggattcttttgcatgagtctggggcaagatcagttctatcaacaactcctcggagcatctattgtgctccagagctgaacagagacatcctgccctccagacagctgctgctctgcctgcctgcctctttacctctctctctctcctctctgtggagattgaacacccaaacgaatctagtcatcctgtgtcagctcaggtcaaaagtcaaatgtcagcctccatcagctcaggtcaaaagtcaaatgtcagcctccactagcctttttgccagctcctattgtgcagaggcggaattaccttttcatggcaggccctttcttagcattagagagggtggtcagccacctgcaagcacattcttctgtcagctcctacctgtcattctgtctgtgcatttgtcctttcttcaagtcccgccaggccttgcctggcatacaacaatctgtgcttccctgaggggtgtggcacatattcagcagctctgctaagaacagcccacatacctgccagtcaccttatcccaggagaggcacccaacttgaaaaccttcacagaggagtctggagagagatggaccctacctaccattgtctcagggagtcattgctcaacatctccgccactgaggtggaaagatgaggtctgaaggatcccagaggtgggtactgagaggcggtcacagactttgtcccatcatcagaaggcagtaggagctctggcaggccccgccccagctcaccttagttgtgagagagcatccattgccatcgacctcacgggagaaaccaagtggtcaggtggttctgctttgatgatcacctgtccggcacaagaagggttgtgaattgttgctcacccggaagttgagttaggcaaagggggtgggggtgggggtcacacctccttatctggtgccaggataaggagggcctgggtctttgtacagagctctggggttcacatgcccacattctttaaggcttatttggcagcaaagcacagaggaacacacacaatgggcctaggcttcttacccagggccaccatgacttgtgtgtccttggccacacaatgcaatttcccaaacccaagtttccttgtcctatacaagacttgatgcttagttaacagcttgtgccgggctcttgtactgtgactggggataaaaggcaatgaccatccatttccctgctcctcctgcctctcactttccccaaggactgctgctgatacggtacaggtgatactctcgtcctttgtcagccatgatagacagaggggacatttgggggccaagggttagctgatgcacaggttccatcagtctgtagacagttggctctaaacttcactgatgttctgtgcaaacaattctctagctctgcttctaaatgacctctgtctgctaagcctcttcctgtggaaaagcactggggctgtgtctctcatcagcttgcccccacccatccccagtgagcctctgctgactggtccctgagccagcctcttttgggcaccactgggcacaagtcaatcaaggtcccaccccagttttttgggacatgaaactctccaaagctgttcttagagcctactgttcagttgatcaaatcaagagtggggcaggaaggctctacagcccccatagatagcttacagatatcctcaaggaaattcagccagagcacagttgaagagctagatcccaggccacccaggactggggagtcctgtcccactcacaactatgaggccagtaagagcagatttgtgggcaaactggaagtcctctgggtcttggatgcttttgatggcgttggtgacctgcacaacactcttaatgaaggccattttgaggctgatgtcctaggcccagaggaagaatgtgagggagaacctgtttgccaaggactcacgagagccctgagccatgcccctcacccctgaatccttcccagtctttgaagaagtctttgatcttccacatcaggggtgctctgagtgacagcccccctcacctgtctgttcttcaaccacagtaaactgtggttttgaaaatggctacagtggtcaattttatgttccgtgcatcttttcatggttcctgttgacatgcttgtgtgtgtgcatgtgtgtgtgcatgtggaagtcagaggtcagtgctgggtatctttgtcaatcactgtattttgttgagacagggtctgataagcctgggagcttacaatccagtcagactggatggatcctcctatcctcatgatagatgatccctcaacactaagattacagatgtttgtcaccataattagcttttacgtgggagctggggattcgaacttaggcccttgtgtttgtgtagcaagcactttcagtgacagagtcgtctccccacctcccaccatatgcattttataaccacaagtttaaaaaacaaactcttccactttcatctaccttgacattccaagaaagtatcccacacctctgtgtccttttgaagactgcccacttctctcctttatgaaagtgagcaggccagaagggggggcgtggggagaactggggctcactttgtatttctggggattcacagtcacctgcagcattcaggggaggactgctttatccatgcaagcatgaccccaaagctcaggtgtgagcactagattcccggaggatgactaggcaggaccccagctgcctcctgcacacacaacatgggctgactccctgtatgtgggctacctggcagctgctggagtagtgggtggatgatcttagaggtgatggggctgtccacgtgggtgaggagcatctgggggtggcagtaagaggacacacagctgtacatcaccattagggcactcttcaccgtctctcgcctccaggggtggtctttctgcagaacagtgaaatcggatgcataaatggggagatgcctcagtggggggggggcagggaagggggaatgccttgtggaacaactgtcaggatcaggagagggttagattctcagtgtgacaggccaattacattctagcctcagaaggcaggggtggggtggggaagttggggtctcggacagaggataccccagcccacaaactggctggtctgatcagccagatcggcaaatgctgagtttgactgagagatcctgtctcagtgaataagcagaagagtgaatgaggatggttcctgacatcaaactaaggcctccacatgtgcacatacaggtgtacacctgcaagcatgtcacctacacagatgcccacacacatgcaagcacacataggtacatatccataccacacacatatatgaaaaatggggaaaatttaaagagaggggagcaggcagtgttcaccgggaggggcaagcgctgggctggctgtgattgaagaagccgttaagtcagtgtaagggcttcagtggactgttctttgggtgttaaagcacccgctcattccctgagcacttatacattagcaactttattgggcaccaattgcataccagatactgggcaaaaagaagtgaaccagacaaaggacctacccaccctgggaagcttccatccagtgacacatgcaggggaagctcgcatggacagctctacacagagactagctgcctaggacttacttaggcagctgagcagaaaccatgtcaccctgggggctggctaagcactagataacactattgagaacagtttgctaaaatcaccattgtgtcaatgatgagttcgttaggttcttgtggtaagggctccttctgatgtccattttgccataaagaagggttaacaggagggtgggcaatttaactccctagctggcaagctgttggactcaaccttgtttctttggctgcctcgagcaaatggactggaccagtcaagcaacaggctggccctcacaccaggactgagcattgtggatgctcggaagatgccttggggaagctgcctgatcaccccagttgtcttggctcccttcaaggcctgacaccaagccttgaggtgaggagccttaccctccaggcaccgatctgccaggactgttccgactcctggatcctctcctcaaagtcctgaagcacattcaacactgtctttacctggccccgggcacacagtccaaagcacaggatgacgcccttcagggaagccgggccaaggtgagagcaggggatacagagagatatacaagttataaatatacacatgcaagaacataagctaagtccccccacctccagaacatggagggttgtaaataagaggggtcgagggtactctcacctcccggtcaaaatcattgctgtagtctgtcttgtacagcagctccaataatagcacttccaccctgtcggcctccagacccatgcctaaggtgaaacccagggccctgtacagaaaaccctgcaggggtagggagggaggagaacctcaggcctttctactcccatactttggatgatgctattgggagcccttgatacatagttctgattttttttacaggtatttatatgcattttctatatcctgctaaataaatattcagtttgttttgtgacatcagactgcacaagggcaggcatattatacattttaacagtgaaggccaaatcctttcctatacaagtttcatcagatatgttcctacccacaaacctgggagtatcaattttttcccaactacttcctggcataggataacactggcaagagacggaatatccttgttttatgtgtcagtatgacatggtggcttagggctgtggtggtggtgatgcgcaatctggagacacactgccatctcaactctatccatcaacctgggatgctttcctattaccgagatcctctctgatttctttcaattacttttataattttacaaagaaagaacaagagaaaatagtttgccaaaaaaaaaaaaaaagtacatgtgaccatggaccagaatgaggaagacaacaaaagagatttttaaaatcctgaaaatcactgaattagattactttctttcttcttaggacactaagcagtcatggggccacctgatctgatgtgaaaatgtcatgtgcctatccatccccggaggctcctcccatccccagaagctcctcccatcatctcctgcctggactacgaggtccctatgaggacaaaccttttccaaggaggggctgtcgaaggtctcgatctggttgttcagctctttgctgagccgcaggcttcagctggtcccccgggtcttcttgagggagtttctcagaaactgggaagtcaaagacgatggtgggcggaggcatttgaacccagccttgctcttagctgggtttcggggaatgctgtgtgaccctgaatatgggcttgttctttctgggccaccttctctagaacgccattcagttgatggatggccaacccagctctaacattatgtgcgtctggagcacggctgtggctttagaggctgccgggagatcaggtctttccccgctgcttttccaggcacttggcttgttcatttctccctaactgatacacacagacataggtgtcttctttgttaggtctgctctgacagagggtaacgtggccttcacaagaccctaatcttatccacatcaaatgtccttccaggttccttctcttcttccttactctggcctcagagacagttcacccctttacctgaatcagcatatcttcccaggtcttctgattccaggtaaactcagtgtgctctacaggagaatatgcatgctctcatgggctgctcccttctgctccccccaccccggggtaaacctccttgccccagcatcagaagccctccgtgaatgagttcaccacattcagtatttcccttcccacatcccccaaggtatggggttcttaaggaggtctgttcaggtccaccagaccccaggttcctgtgatccaagtcacgtgactagtgagtgccccagcatgcatacagagtgggcacttcaccttccaggtactggactaacagagggatctcctgctcccacatgtcagccatggaaggagcaatgctctggcttagggtccgcaggaggttgagcatggcaatcccccggccttctcttttatagggtgatgacatcagcacctggagggccccagggagtcagtgagcaggggccaggcttctgctccctatctgggagtccaccatcttcattataaagaggaaagtgagcggggtatatgattttcaaacaaagcccaagggttttcagcatagaaaggcctataggggactctgcaggcaggaaggagatgagaggccagacctgggttcctttctgaccctgaggactcaatggagcattggttagtgcccacaggactgagcctacctggggccatgattggtgttctggtggtgttttatggcacaggaatctgagagcagatcctggccaggttcccagacatctgagcaccctgtccctgacatatctgcccaagaaggacaacacagacctccggactctattctgcccaatatccaacttcctccctgcatcccaggtccctcctccctctggagcatggagaacaaagagttcagggaagaggtgtcactgcgaatgggtgctccaggccacggtatgtcagccactcaccaggagacggaccagcagcttctggggtgcaggcaggtccactgaggaaggaaaaggaaccccagataagggtgcctggcccatttcaagacatgttctataacccccaagggagacactttgaaggtcactttccagaattatgactattaccccagagaaatattctaccaaagggagtttctcatgaagaacctcactggctccttccaaaaagaagggaggattttgctcatgagccaggctcacagatgatgtgttttaggttttggatgtttatttttgaatggatctgccagggcaatgtctcctattacagaccttggcctctcttctactaggagtgatttaattccctaccctggctccctctgtccagtcgctatatgccttgggaaccagtaagcccttgaaaaacaatggcactcaggtgtataaggcaagggagagggcagggctgctgagaagctgcaggtgtggagacccaggagtggactcaacattcagagttgaaaggtcacagcaaaatggattcacttaagcttcttagcttgaactcagacgcaggccctgtgtcatccttggataggaacagccctcctgaatcaccctacccactgtcatgcctgaccttgggaagccccagggggccatgagagtatccccttgggactggacatagcagagaaggagaacagtgacatgatacagatggacatggtcacttgagagcctgtgttgactgtgctggccctgagtggaccacagtcatcagctgacagagaattggacagaggaatgctacagttcctctagatggctcagagaagctgggcaaggcaaagacccagaaaggccacagctatagctagggtcaggagccccctccctgccctgccctgcccataatgagtgcgggggaggcagggacatgatgaatgggccaccaggagaaagtctgcaggctttaacccctctctagacatgacagggaggattctagatgtttcttggagaaggggaaatttggttgatcaggactctgtgacaagggtgaccaggagccgtttcacctgctcctccccaccagttgacccagggatgccacccaccatgcttgctctttccagctattccagcctccgtggctttgccatgaatttggttctcggccaggttcgtgaggctgatgcagatgggggtcagcgcctcggtgtagtctgtctccatgatgtagcacaggagcctcacccagaactcctgggacaggaacggggaggggagggcccaggaccagttagaggtgtcctatgctgctcccccaaacccccatccagtactgtccaggctttacccacagtgtggactctacctggcatccccaaagctatcccaaatactcacccgactttcctgcccaccctggatgtttttcaggggcatccagatggcatccatgcagccctgctagccgtgtatccactctatatcctgtacatcctctaaccagggcctcctcctgggtcccaggggcctctgagttacaaactagtccagtaatccaggggtgcctgacggttgtgatgctccggtgtatttgtcaacttggccgagcaagcataccctcttattaaaccaaatgccggtccagcattgctgtgcacacgtcacacagctgtgacaaagctcacaatctgtaaagaagattgcccccgagtccaggcagccaagaggcccaaagagcacaatacctcagaagaagaaattttgccacaaaacaacacttttctctgcagccctacaactcaggcttgtgccctacagcctctaaccctcatctccagtttccattagataggaggcatccagcctacagttttatggtcagccactcgttccttcttggtgatgttatggcattttttttccctgcctcgttcctatgtttcttctcttcccattaaaatgaggtacactgatttatcctataacctggggcccttgaggtcatatagagtcttcctagctcaacttactgaactgtagaatgccctccccaagagaaacgttcacacacacgcttcaggcaaacaaggtgactgcaacttattaagagaacacctaggttcctccaccagccttcagaatgcagccaggagccatcatcacagcaatggcccgctgggtggggagtgactcacattggtcatgccgctgatagaagaagttatgatctttacagtatccatggttactttgtgaaccatcttctcttccaaatccctctgataaaagcattcccggagatttgtctaagaagacagaaccagggcaatccttcaggcaggggcttgcctagatctcaagagtggtctctctcttccccagggagctccctgcccagacactggatcctaggatgctaagggctgggccatacttacagggtaaccaagaacctatacaggtccaaacaggttctcagtgcattgttctttgcttagcacttagtaatccatttctaaagtggagctgccctgtgggattggtgctggggccactcaccagcttgtaggtagataaggtgagctggacagacacatatttcagaccccagcctttgatcttttcctggaagcctgacagaaccagctggccaatgattcgcagaattgccatccgtacctgtggggacagggtagggacagcttggggggaagggccaggcttcagcatggatatttgcatctaacgatcttgtggcttgaaatgcctgggaactgctggtgctcttggctccgagggatttcaggggctacctggctactccccactctgcccatcgctgcttgctgcacggtggaacatcattctgcagtgttgtcacatgagtgtctcagttgggcccttcatagacatcttcattccattctaacattggtcataacagccttggtgcggaagcctatattaatatttccccctctggtctccctcaggtatacagtaaaacgtaggggtggggtacaaaatgagtcatgtttcttatgtcttcgtggctctatctaaacgccctgccccatgttcgccagagcatctctgaccatcccttccctgacactgctttcgcagcattccaagctagctgcagctcaggcctgtggtattcagctaggtgaggatgtgcccaggagtgtgtctccccagtcacttttctcatgagcagtaagatcactagacagaccctgtgtggacagcagcctttcttccctgcaaggtagaatcggggcacactgctttgaaagtccctggtctcagtgactgcgctacagctggcactggcttgactttgcttgactgaggtccactattccatcctccaccccttagcccttagctaccccagcagggtccccttcctgttaccttggaccgagtgtcagagagagtgttcttgacgacgcggatggccaggtagatggtcttgatattaattttggggtctgaaagagacagaccagcctgaagaactgtggctcaagaagacgtcgggtggcttgtccctgacacatcccactcagctcccttccacagagcacaggctcagggtaacttccttaggaccctcgccagtagactccccctgagcacagccctctcttcccacatgcacacatgcacacacacacacacacacacacacacacacacacacacacacacatgcccacgtggaggtcagtggtccatgctctgcatcttccttattttttttttttcaggacaggagctctcactgaacttcgagttcagttcagctaagcaggctgaccaatgaattccaagctagcttctgacccccatccccagtgtgagttacagacatacgctgatacacacccagctttctacatgggtgctcagggtctgagcacaattggtcatgcttggatgacaagcactttacccactgagccatccccacagcctccacatagactagtctaatgttttgtgttagctcagtgttttaatgaatatcttgatccgaatatctttgggtaattattgcccagaggactgaaaagaggatggttagacccaaggtttgattattatccaactaagcacccataattgttcagtaatttgaacccatcagtgacaggtgagtaaccagtttcttgtggctcctggctaggacgaatcaaggaactgctcacagactggatccagctaaatccaaacaatctgtgtaataatggtttgtttggttacttacttatttttatttttatgtgtatgagtggtttgcctggataaatgtccacacacacaccaggcatgtacctggtacctacaaaggttaagagaagatgttgaaggcaaatgttaagtttgtagacctagagttttgtctgcaaggttacggccagccttacaaccagcctccgacagttggaggtcagcagcaggattcaggctgaccgtgaaaggcaagcccagagggcagaggtatggaggggccggggtactggttaaattcaaggctgagaaatatgaagcaatcaagagacttggccacccaaccagtgactactagaataggacagaagccaggtaggaacttcactgtctccctcatggtgcctgtccactgcagctggctcaccatctgcgctcactactgccctgatcagggccagtgtccccacacggacagcctctttgctcatctccacctggctgaagaagaacttcatcagttccttggggtaggagcgggctgcagggcagaaggagcagcatatcagtcaaagctggcgggctctgcctccatgcctgcactgggcaaggggctgagcctccccaggtccctgcagacctcacccagggctatgaagcagtgcacgatctccatcaggttctgactgctgaactgctgctgggctggggccttggagcacacctagaggagtagtgcatagggaggcccccatgcctgcatgccagtgggatgcagtggggagaggggaaaccatgccccgagaggcagtttcctcctgattgcctgggggatgccctcaactggcctcacctggacgtgcaactctgtgaaaatggggtgtagcagcatcggggggataggggtgttggtggtaaccgatgcttctagaatctgcctcaagacctgcagaagggatgggcagaaggctgcaggtgaagtgactgctctacccctggtttcttgctactcagcaggccattgtgtgatggtacaggttccccggtcccaccccaaccccacaccagctggctgagtgtagaggctcggttttctacaagatggacttgatccaagcctgtatttccaccttccctggatgacttgtgtgcctgataaacttggagagtgtgctgggggccactgagaaggtcatttcttgttcaccagagtaagggatgaatccaaatctaatcttcatccgcaacaatatatgcaggcagctccctagtcctgtactgttcatttctgctccttatttttacaataaaggccaatgcccggtacctttgcttcatttcagtgtgcatcagccggggccaggcctacactcagaacctgcaacatctccacctcacacatcagagggtgtggaggccccaaacctattccacccagagctccagactatatccttttacttagacataaaaatctctttgggtataactgctcaagggtccaaacaccccatggttcttagttacagtgacctaagcaaaaccatagcttccctgtggcctcctggaccctttgagatccttctacctggaatgacagcttatttccgtagtgccagggtcgggtgtagggtacagatgtagggcctgctggcacctgaagattattattatttccatagtgccagggtcgggtgtagggtacagatgtagggcctgctggcacctgaagattcttgaggatcagagtttcttgagtctggccctcacctgtgtgacgaagagagcctccaggccaccctggaactcagccagcagcagggggatatagtcatacacctgttccctcaggtcgtcattaggcaggagaaggctcagcatgggcctgagagacttgatgactcccagtttcacctgtgtaggaagtgagtttccagcaccccagcaggaccagggtcttagtgactcaagcactctccggcatcatacagatggggtactatagatagtgtccaggcttccccctaaagcccccaccatggttagtgaagtggggccagactagctgatgtgagttctgcctgtaaaccaagtgaccgtgggcacgtgcataaaacaaaacaaaacaaagcccttctgtgcctcagttcccttgttcgtaaaaagtggtcctgccttacagagttgatatgagcacaatgttcacaatcaggatatccagggaggatctggagtgggacaggtgccttccagtctcagaaacctcatctgaaagctctctgtgggcctttgcccttgacacaagcctcctttacccgctccatccagcattcacagagtcctagggtctcagggctccaggaacaaggtggaacccagaagctttgcagtatcttctgggaagtgtaacccagagaatacagagacctccgagcactgcgagtctcacctcaaggtcctggtggcgcagccacacggtcacgaagtatcggtacattgggaagagcttcacagcaaactggtcctccgtcatcacgggatacaggctgtcctccaggtgcctcaggtaaaactgcaccgtctcacagaacgtctccatggctgccagaagcaggacaggcaggagggttggagccactccttcctggtattcttggggttactgggtctcctcctctctgttctgttggctgtttgcagccccctgattccatgtgagcactgagcatacaggtatgtctaagcccctcctcttggggatacaggatcagagtgggaccacaatctggagattccagttaggacagcaacaaacacaacctcttttccttaggcatcagggttttgggacccaaattagtgtcaaataaccaaatcacagggccagatgctcagatgcaaatagcctccaaggactttgctgagacaagcccaacagagaacatgtgcactgccctttccttcctgcaactgtctctcacctttctctgaaagtacagaacaagctacacagagtcacagatatgaccatggtcttctaaaatgtacccacatgcccccaaggtggcagaccgcaggctatactggttagcttttaatcataaaccagagtcatctgagaggagggaacctcaattgatcaaacacctccatcagactggcctgtaggcaagtgtatggggcattttcttgatcagcaattgatgtgggaggactcagcccactgtggtggtccttagctgtataagaaagtaggctacggtaactcatgagggacaaactagtgagcagctttccttgacctctgctttagtttctgcttccatgtcccttaatgctggatgtcaagttgtaagctaaagtaaactctttcttccccaagtagcttttggctatggtgtttatcaaagcatcagaaaccctaactaggatgtgaaccaaacaaactcagagactgagcaaagcaaccactgggatgcaaaccaacttctcattcaataaacccttattcccctcctcaccccctttatccctctggttaaggcttgacccacaggcccaagtgagacacgcaccactacagatcacctggcgcatcttggcttcgttggcaagtctcaacatcgtgaatatggtagccagggtgatgcccatgtagggcatgaattcaaacactgtagaacatcaagaggccacagggaatcagggagagggttgagaggggagaaggtagagagagtgaccctaccgcccaccaccttaatactcaggtgtctaccaggaaaccctttgccatcaataatatggcagggaatagggtgggatgccacatgtttaaaaagggtgaactgaaaagaagagaagggggaggatgtgagagggagcagggaatcgaggagctacagaggagtggagggacagagagccacaggacagggagaaggctgatgtggaaagaaagggcaggagggtcctggccagggagcatgtctgctcaagggcatatgtgtgactcttgaagaagactcggtgttctctattcttggatggagaaagacagcagacaggactcacagacatgagagaatcccataggagacttccagagtctaggtctattcttctttccaaacctggcacctccactcaagctgagagcacccctctacatttcctcagattctagactcacagtgcgtttctaatgatgaactaattctctccttcactaagagccccagcaagccccatcaaccaggatccattcccagctgtgtactacctactaaacctgccccagccctcctccatctacacagtgttcagaattgtcttcctagaactggaatttcatcagacaactgccccttagaaatctctactagcttcctgcaccttaaatgaagctagagtcctgggattgctgatcccagtctgcctttctcacctaacgcccatctccccgctaggcatctccagccacaggaacctcttgggtcttcagataaatcaagttcattcctgccccaatgcctttgcacatggtgttctcaacaagtgggattttttttttaattccatcaagctctctgcacacacgccttccctcccaagtctcagctagaatgcaactgtctcactaggagccctttccatagctgttctcacacagtcatctcggccatcctcttcatagctgtcatctcctaagcatctgtttccttgtttccttgtttatggtccctacagaagccaggaactacatgggtttttctcaccattgggtcccagcacccagcacaggctcatggggcaagagttccatatgcttttgcaggtggaaagaaggagtagaaaatgagcagagaaacagcgggggagaaacaaaatagagtaggggtgagtggggagatataggtgaagagaggagacagacagacagtcagacaaagagaaagcgaatcagaaacacaatagaagggaatctgagtggtaaggactaggcatgtcacagagaaagagagagaaatgcaatgggtagggccagaaacagaggtaaactgagtgacagaagagcgagaggccagcccaatctggccaggaactggggttaggatctcagacccctaccattgccattggccagcttggccagggtgacaatgacaaactcgtcagtgaggttgagaggcttgagatgatgctgcagttcatacatgaccaagctgaagtggtttcgggacagagccactagagtctcactggccacctcggcggtctcaaaatcctccgcctgcagggaacaagagagacaccgctagccctctcctgacttgatcaggttcagtctgcctcagtttcatgagacagcctgggccaggctcaacttcagtccagctcctgggtctgcagaaggaaggcatggtggaatccagggcctactacctctgtgatatcccgcatctgcttggaggcaatggccaccagcctttgtatacagtgctcctccatctccccttcctgctggatgatctcctgcatgatgttgtagatgttcattttgcgttgggtagaaatctaggagcaagcatggcaggtggcagcaggggtggggcttttccccagcaccacccgccatctccattccccaccaccttgtctcagttctcctccatctgcagcccctcccaattctgtgcactcacccaacactccccgtccctagtgtccccgtccctaatgtccccatccctagaacttacaagtcttttctcttggctcagtcaacggtcagtgaggaaggtgtcatttggtcaacacacaaggtccttcacacactaaatagtgtcaggcttgagagcccaagaggcaaggactcaggcaggaaacagcttctatgtgggcagcacttattaccaaataaggtgtcctggtttaggatggagttgggcagatggcttgtgtgcccaaggccatatctggatagttacatttgagaatgattcttactatgtgcatgagtgcatatgtgcatgtgtgtgtgcatgcagacggaggtcagaggatagcccaaggggctgttccttaaatgctgctcaccttgggttgtttggttttgcttttgtttttttattagacagtgtctctcactggcctggagcttgccagatagactgggctggttcttcctgtctctgcctcctgattgctgggattacaagtgcacactaccaggcttagcatttttacgtgggttctgaggattaaacttgggtccttgggcttgcaaggcaagcatgttactaactgggctattcagtcatgggtgactttacacggagcatcatgagtctaggctttgaactctgaacacagaggaacagtgagaccatggtaactgttcagtaaggacttcatggcactagtggcactagaccaagttctcagcctttattgttatcattgcccctgaagtagccgtttttttttcttttggtgtttccctaagtgtccctgccacacaaaccttaaagcacaaagaccagcaaataatcatgttttcttttttgtactttctgatgccttgaggtctgcagatgagcaatgctgtagagcctgcccttcctggtggtagccaactctaagagatagttcaccatttgcttgtgtgaatgctttttgaggtagaaaataaagtctcttatagactgaattggattccctcaaagatgtatatgttgatgtaaaccccctaagttgaatggcattttgaggggggcctttgggaggtaacttggacttaataatgtcagaagggtggggccctgatccaaagggactggcaactgtttggaaaaactggagctccctgtatctgtctctctccataaatcagtggttttcaagcttcctaatgttcttaggaacccttgaatacagttcctcatgttgtggtgactcccaaccataaaattattttgttgctaccacacattttgctactgttatgtaactatttgatatacaaccctcagaggggtcatgacccacaggttgagaatcactgccacagaggaaaagccatgaagatggtgtcagggcagctgtcagtaggccaggaagagccttaacagaaacctgatcatcgggcatcttgactttggccttttaggatgcagaaccgagaggaaatgcatatctggaattttagccacagagtttatgacaacctgagcagactgcaatcccagtcaatcctgagaccagtccccaccagccagggacctcccaaacctaccacaccagacacaaaattgcctcccaaacagatcactctaaccccaactagccctgaggaatatgagtgcctctggtgtcagccatctctgcatcttggcccttaacgctgtgttcatggtgactgaaaaggtgtgctgaatggtaggtggactcccaggcatctaaatgtatctggtcaaagaggaggtctggcggcttagggtgtccctacctctggcatctgcaggcagcggatgagcgcgttcatcactacacagggatccgtggtagccttctctgtgattatcactgaagccaaggtcttccgcatgtccaggcctggccctgtggtgtctgtctttgctgattcactgtccatgatgttcaggaggttggtgacttggaagaatgtacctgacacaaagatggtgtaggtgtggtgttgagtggcccaagagggaccagtggtgtggtgatgtggttgacttccttaccatcatcctctggctctagaagtgccagatgctctgcttcctccaacatgtcttcattcaactcagtggcttctttcatgtctcctcaagtgccttcaagatggatgagattaataaatactccatgtgacaacactccctaagaagacctcccaggagctcacaaactttttaaaactcttccttcagtgtgggtagaatctgtgactccgtttgaaccattaaataacgtaaaaggagcaggatgttccccttagatgcaatgcttataggaattccctctcttgagttgcttgtgttgttggcaaaggtgatgggaattgacttccaggatcacattgttcacatgggggctcttcacagactagaaaaagacactctgccatcacggagaggaaagattggtgatgtgtgctgcctatggagggaccatgtggtttgaaactggggttcccagtcctgtaactacgggaactgagttgtgccaaccatcacatgcagaggaaaggttattgagtgcaaaagagaaaagtaacattgcccacaacttggctgcatcctctaagaccatgagcagtgggcccaggcaagccacacccagactcctgcccatgtagaaactgagatagtgggaacttttttaatctactaaagtagttatactttgtcacacagtaataaaccaatatgcttagtaaagacaatgccctccctcttctctagatattacaaatttgggactatggaattcagccatctcactaacttcaacagctgttcaatacccaaagtttcttaataaaagacgaaccagaacagaagtccctctcagaggaccaaagttccccagatacttcctcctccagccccagttcctcaaccctcaacccagaatagcacttcagaggattcccaggacctgaacagtggccttgtcacgaagtcctcgtctgggtagaacaaaaatgttggctgaggaagatcactgctttttatctaatatccaccaaagaaaatatgaacaatgggaggacccaatgtccaccacagacactcggcctcctccatggtaatcctcatgaggaacaggactccttgcatggctggaggtttcattagaaccatcacagttatctcccagacccttggaactttgagatccaactgcctccccaaggcactctcaaccagagctctgggtacattgggctgaaatcaaagcttcacatcaagtttccattaaatatttatatacccagaggtgtgtgctgatgtatggtggcctgtttgggaaaaggaaatcactagtgggggttacaaccaaggatcaaaggggtggaggtagagcccagtatagaaaggtggagtcaaggcagctgaagggagggaagagcatgggatggctgtgaggagagacctccttcgtcactagggctactcaacagccaggtgaggaagtgtgttctaacaactggaccagaagccaggtgaggaggtgtgttctcactgggagagtctcagaagataaggaatttcaaagacagagaagaataagtattcttccataaaccaaaggtggacctcaaaagacctcctggtcacctgttgctaagagatctggtcaagagcagcagtttgtacaacaaaagcatcggtctaggggacatccttcatgcatttcaggttaacagattgactccgagtcatattgacccacggcttctttattaaaattccattttgagtctgcccatcttgacaagtgagagtttgtactgactgatggatacaattttgttttgttttgtttttgacaatttgacataagctaaagttgtctgggaaatgggaaccttagctgagaaaatgccttcatcagattggcctgtaagtaagtctgtgggacattatctctctctctttttttaatctttaaaaattatctatttacatgtgtgggtgttttgcctgtgggttatatctgtacaacatacaaaactggtacccatggagctcagaagagggcactggatcacctggaactgaaattaaagatggttatgagtcaccatgtgggtgctgagaattgaacacaggtctacttcaagagtagctagtgctcttaacattcaagtcatctttccagcactgggataatttcttgattcatgatcatgtcagaatgcctagtccactgtgtgcagtgccactcctggaaaagtggtcttgggttatatgaaaaagcagactaagaaaacatgagagcaagccagtgagcagcattcccctgtggcctctgcttcagttcctgtttctgggttcctgccttggctaaactgactgtgattggaatgtatcagccaaataaactcttttcttcccaagatgcttttgttcatgatgtttattacattggaaagcaacccaggacagagttccttcacctctacctgcttgcttctaactcttcactccatcccatttctactccatgcaatttaaaaggttaaaatatgagttttggggctggagagatggctcagtgagtgaatactagctccctaagaataagtgccctagtttgaaccttagcactcacataaaaagccagtcacgactctgtgtgttttcataatttcagatttgggggtggagatggatgactcttgggagcttggtgattgactgccatggaccacctcagttgggtatggggatccctggaatgagggtccttgaagctaggtgggtaaggatttggcggtgacaaacagaaacaaacacagaggcagtttgaatctgagtgtattctgcagctctcaagcaggggattttatacattaaaaaaccaaacattacatctcttagaaactatatccagtaaaacaatcacagataccaacaaaaatcatttggcacagtaaagcacaaaaatcatccaagcattacaactctgaaactatgtattcagtgaatcacaaacagaacaggtaacatcattgtaaatcatcaaaatataacaattctaaaaggatgtacttagtgggaggctgtcgtccaaggctagtggcatatctccaggagcaggttaataaatctttaatggtcagtgctctcaaccactgaactaactttccagccccagggtcaattatttaacatctagtgcctgattttttataatcttcaatgtataaatttaaactattttaattctttctaattaaggctttctttaccatatgccaaaatccacctccgatgatacacgtgtagccatatgaaattttattgttgggaaagtttttatcataatagttttgtaaatgatttcgaaagtcaagtgttggtttccctggggataaggtcatgttagtggccccttatctagggatggtttcttgcccattattcttgcttaagatcttggcctaggctaccaggaacatgtaaataagaaaaggaataagagaaaacaaaaaagacaggttgccatgagaactacggctcaatatttttttctccagcaaagagtttcacaactggttccaggaggtctctcccttttgaggtcaaccgcctcagtctgtgggaacttgtcacacagatcctactggaggtggtgtggcagctggccagctagttaaaacagaaatttcaggttcagtgagagactctgcttcaaggaaataaggtaaaaagtgatagagcaggatacccaacatccttttctggcctccttacatagtctcatgtatacctactcatacacacacacacacacacacacacactggcaaaattagaatgacttccctgcactccacaccaaatacatctttcccataaaccccagcactgttcctcattctggccattggagacacattagtcaacatgaaacaaaatataaagacagttgttcacaacatcctctccacctccccactgggccttctcatgaccttcagtgatctctcaagtcatatgtttggggttaaaaactatgtgtgttgactgcaagcctaccaggtttggctaagcatgttttctgttgtccatgtggatacaggactagaacatgcctttgccctctggggtcttcagatataatacacaagtattgtatgggttagaaccagaagtaaatgtgtcagcaattgatgtgtaccaaacattttcaaaattcaatgtctgaaacaacaaattattgtctacaggtcacctagctgtgctgagttgggtcacatctagctaagtacaactggagtcactttgtgcaaagggcttgctgttggcagagaagatactagtgtggaggtgccatatggcaaggctcactcgggtagttctcattgcaatgcagcaagatccaagagaatgaggagaaatgaggaatcctggtggggactcaactttgaatgggcaccaattccttctatgagctgaggcaagccaggactctaaggacaaagacatgcctcaccttgaggggaagagtttcagagtcataccaaaaggctgtaactgtcagcagggtagagatatggaacatcttttaaaatggcacccagcatgaatgtgcaaagcataacaaaaagcaaaatgccaaagctggagggatggcttggtggttaaactattgctgagaacctgggcttgagtctcagcacccacatgacaatttctaaccaactcctgttctagggcatctgatcccctcttctggcatccacaggtacctgcacacacacagtgcacataatacatgctggcactctgtactggctgcttttgtgtgtcaccttgacacaagctggagttatcacagagaaaggagcctcccttaagaaactgtctccatgaaatccagctgtaaggtgttttctcaattagtgatcaagtggggagggcctaaccatagtaggtgatgccatccctgggctggtagtcctgggttctacaagaaagcaagctgagcaagccaggggaagcaagccagtaagtaacattcttctatggcctctacatcagctcctgcctccaagttcctgccttgtgtgagttccagtcctgactttctttggtgatgaacagcaatgtggaaatgtaagctgaataaacccttcccttttcaatttgcttcttggtcatgatgttttgtgtaggaatacaaaccctgactaagacaaacacacacacacacacacacacacacacacacacacacacacacacacactttttaaaagcaaaatgtcctttaatcaattgtctatagagggcacttggacaatgaagctggtaagtaattagtgggctatattggttttccaagccaaaatttctttttctttttttagccttaagtttatgacaatgatgattgattcacatacgattaattcttttgtgtcccaattccattaagctttccagcttcacttctttgggtactaatcaggaagcaaaaaatgaacctaaatgtatatgttatataaatctcatatttatcagtaaattgttttttgtgaagatattgtagagagaaaactggtaccaaatgtgaaatcattactctccagaagtttgaagaactgttagaattgattaatgggagaatttggaagagaattctcgagaaggcttacaatgctgagatgagctggtaatgctcattctttggtcaaagaatcagaataatatggatatactttgtcgctgacctgagagatagtgtgggctaagcaggtcttatgttgatccatctggagatgaatttgtgctgggtgggacataaagagctcatttcattcttctacatgtaagtttccagtttgaacagcatcatttgtagaaggtgctgcctttattccaacatgtgggttatgtggcaaaaaatacagtggctttaactgtgtgatttatctgcatcctcaattctgttccattgattaatgtttctgttttcatgctaggaccatgttgttcttatgactacagctctggactattaacttgaaacctggaaggtgatacttaccagagtttttattgttcaagattgtttcaactatcatgggtttttgggtttccatgtaaaatttaagattagttttcaattttctataaagaatcgcattggatattgatgaattacaacgagatggcgtttggtgaaatgactattttctcaatattaattatgccaatctatgaacatgagaagtcttttcatctcctggaatctccctcagtttctcttttcagtatattaaatgttcattgtatgagtcttacactttcttaaatatattccaagatatttttgagactattaggaatggaattactttcttgatttctttcttggtatatttttcacttgtatctttggagttgctggccactgggattcttctggactcccccaataatacaggcaattgccaatgctcttgattacctaccagaatttgacggtaaagcactattgttgaaaacactacatacttgagtcacagagcccaaagaactcaaaatagtagtcttccagaaactccactcctccttgctaattttcatagtgatgtaagatgcaatgtacactacctgacagaaactactactccttgctaattttcatagtgatggaaggtgctatgtacactaccagagaaaataatcaccaatcctaccccaatgtatgaacacagtgagctacaataatgactggccaggcaagacatgctcactagtacagtggtggcatgaacatcataggagcaaccaagaactttctgaatgaatttaaagcacatgccataagttgaaatttatacttggcattaatttccagttcaagattccatgtgtagacaggtcatagttccaaaagagagcctactgctactgttgctctactagatggccattgcattaaacttgttcctaatgatgcattgctctacctgtagattagtggatctctcaaccctcatcagaggagctccttttggtagtagatgatgattaccataaaaactcacaactgatcaagatgcagagaataagagactttagactgttcagcctccaagataatatctatatcctacatcctccttccaagactcagaggttttgtggaagtaggggaacagaaagattgtaggagtcagaggcaatggatgactgtaagaaaaaaaaatgtttcctggatacattagggcagtttctcatatgaatacaaagcagttaggacagcatgcccaagacctgtgcaaactcaagacaagtaaaatctgtttctaagcttttccaatggttccaggagatagagggcactttgtgttcccatggctatccaggtttcacgtctctgcatccagccagcctctattccatattttcagcaaaagactcaaatgtcatcattggatgctggttttacagttatgcaaattataagttatgtggtcatggaggcttccaccagatctcaaagcctgggaaaacaggcagagctgtttgccacacccaatgcagtgttaagcagtaaagctgagggagagaagccaaagctataataaagatccaaggtcagaagagatgcaatcaacctgtcaaacagggagggaaggatccaggaagtgtgaaaaccagtttgaaagggcaggcacagtaggatccaacctctgaagccacagaagtgcaaatggccatgctcattgggagtgttcattccaccatagtgagtccttggtaccaaagatctttggtgtttgatgtttccccttttcttatttctccatgactcccgttcagaataggggacgtttacatgatgtctgagctccaatgagtttgtgtgtgatttgggttttgttttgttttagtatttgtttttctggttctttctttttacagaggctcacaactgtcctgagtcttgatgagaccttggacttaaacttttattgctagaacaatagatcttgggactggctttagacaaagaattactccattatgaggtctcaaatgtcttggaacttgctttgtggaccaaggtgcctttgtactcagagatctacttgcctctgcctctctaggttaaggtctggcattaatctattttttttttaattgcgaaatggacatgaacttttggaacttttggtcagaatatatagcttgaatctgaaatgcccccaaagagccatgtgataaaagcttggtcttcagtgtgtgctattgagaagcagggaaaactttttttttcaggtagggcctattaaaatgcccataggtcattaaagatcttcctcaaagaggattgtgacagcccagactctagctccctgttcctgcctcaagatataattcatggtttgttcatgtacatgctcctgtttgatatgccaccttctgttaccctcacagaactgagccaaagcaagataacctctaagttaaacagcccttctctcttttaacttacttgctttggttatttcattatgctgatgcaaaactgactaatacagaatgtctgtaatgttttatgtgtatttgtcaaaacaataggtatgttaataaactttatgttactgtaacaaatacctgagatgtagcaactcatgagcaaaggtttattttgggctagctatagacttttcatccctgatcatgtgggttatgttgctttgggacctgtgtaagataagagaatactcaaagagactgtccgggaaccttcttgtttcaggatagtatgggaacaaagaaagagaaggtacctctatccctgtatctccttcaaaggaacacctccagagacctagctttctcacactagactgccacttaatggttgcacaacttcccagtgatatcacaggctgagcatcagcaaggctgcaagccatcagccaatgcacctttggaagactcagaatcaaactaggcagcagccatggttattcatgagcactgtaattacagctggttcctttcttgtgtgtatgtatacctgtgtgaatctgttctagttttcaagttctgcatcatgatcatgtagtgcttttacaattagaggatatactttgacaacaaataaatataacaccaatgaaaagaagagtagtgatacaatttatatgaatttattgataagttcttggtttgggaacacaatagaagatgtacttgccttagaacatactttggttttcatcaaattccggcacaagcaacaattattatctcaaacacagggccatcagtgtcacagcctcatctcttctcccaaagctccaaaggtcttgccacccataatgcatgaacacaatgaagaatgactaacactggagaaggccacggcagtctgagaatccaggggagaaagccgtcagctggcgggagcaggggaaactgtggggctgtcactgaaagcagagtgccagactttctgtaaattaccaacagatggcaagagttgtctagactgaagatactggaaaagcacatcacatatactagaaccttccctgatgggtgtggccagcaattagattgttattattattatttttaaatgtgctgaatgtataatgtatggtgaattatttccctaacaaaaacaatatggatttaacacttgtttccaagtttcaactgatcagataatgaactaatacttctccttcacttccccccacttctcaatgggtcttggatttgtgtgatttcttcactcgcccctttcccccaaagcatttccggcagccataggcacaacatttaaagacaatgaagaccactgtcaacacaatggccaggaggaagccaatcacatccaaggagtggtactgataccaggtgaggtcatgggcggccgggcgcaggtgtggtgcccccttgtgcctcatcacgtattccacccagaacacagccaggtccagaggctctataggacggtccttgtgaaggctggagaggcgcatgatgttctccttgtagctgaacacaaggcaattgttagtgcctggaacacccatgtaacagacagcattcccttacgcttgactccagttaagaagagaagcgtacttctaatataaccagatttttttttcttttttctttttctttttctttttttctttttttttttgcttttagtgatttctttgtaggaaattatattatgccttccttatggtaaaatgaagttgaggaggcatgaactacagatgaaagggtagtgtggtttgaatgtgctgcctacaagctcatgtgtgagaactttggtccccgaggtgaaggtacagagaggtgttagaacttttgggaggtgagaagccattgagagagatggcggcctttgtccccagagctggaacgtgtcactttgagagcaggttgtgatcaagcatggatgtcatttgcattttgtctcttgcatatacacatcctttgaacctccaggtttctaccatgtggagaggcagcattagaccaacaacttctagaactgtgagccaaataaactttcatccttcataagtcatggcattctggatattctgttattgcagcagaaaacaggctaaggcatgtgcctgaaactttcacatacatgttctcatgagtacaccaaatgctgctgctgggttaaatctaccactggccactatttcttctaaaattttgtggtattgcttttaagatattatttttattgtgtttatgtgtttgagtctctatgtgtgtgcacacatgagtgcagcgtccatggaggccagaagggggcactggattcccctagagctgggaaacaaagtaaggttgtatggaagagcagcaagtgctctcctaactgccgagccatggttccacctccctaccttttaaattgttgtctggagatttgctgttgtttatttgtgtttgtttggttggctttgtcttaagatagaatcttgactatatagccttgaactcttcttgaacttgtagcaatcgtcctgtcaccaaagtgctgagattataaatgtctgtcaccatgctggtctttccagagcttttcaacaaaatagttccagtaaccttgacagcaatatactaaatttcaagtagagatcaagcaatctcatggtgtgtgtgtgtgtgtgtgcgtgcgtgcacgtgcagtcatgtgcactcacacatctgtgtctgtgcagacatgtgtcgtctatgctttcactcaagggctgtaagacaatcttctcctctgtggcacttcactttatttctttgagacagtttctcatgggatctagatctaggcaggtggctagcaagccccagcaattctcctgcctctcccttccactgtgctgaggcctggcatctcacataaatgctggaggttgactcggtcctctgtactacacagcaagagctcttacccacccacagagtgctgcatctctccagcaccacccctacacatcttttaatgggacatttctctcttggtaggatcttagagatgagatgcctactctggtgatattatttttaattgaagattttaaatccagggaaattatattttaaaaaaaacttttatgataaaatgtagtcattttataaataggaataactcccacattatcttatataaatatagatttttttaaatgtatttgttattgtgctgcttgtaaatgctgtaggtatgaatacaagtagggtttttttgggttcttggttttatttgttttttattttctattacctacctcttgttgttgatgacagttttaagggcattttccaaatcatcagcagtcatttcaaggacattcagggtcaccccagctccccgagtttccatgcgcttggcattgtccatctgatcgccaaataggggcatcatcaccatcggaactccattgcatattccttcataaataccatgggagccagagtgtgtgatgaatgcccgagtctttggatgacctgagaagtacaacagacaaggatgctgagctcgccagtctcacagagtctggattctgagaataccccagggactgttatctacatgtgaccattgtagaaaattggggtgggggagggggagcaagagtgatgtatgcaatgtcttatgtgtacggaccacaatcaagctaagatgtcatttaaaacattcatgtttgtcatttttttttaatttaaccctggtttgattttccatgtcagatgcccccaacctaccaagcagatcattttggggtagccatttgacaagaattgtgttctttgcaagattcgatggtctagttccggtgtagcgccacaggacctcacaggggcaaaaagcacaatgtttaataaaagaacacaatgtgattttttttaattgcaatactagctagaaaggccagttatctggaaagaacacctatggcctctgcatgtgggaggtctggtgcataggaagtccctggagctcagacaacactgtatcttgatgctgaagcctggtgatttgagtgtgagaagccaccaagccaggcactgggaaactcttcacttttcttcactgcaaagggaaactttcttaacaaaaccagtgaatgtccagagctaaccaaggaagagcaaaccaaaactaaatctttttggtaaaacatcctcatttggtatgaaaaagagttccatgcttatttttaactagtttctccctaatactttgaagtttcttagagaaaaggagaaatctgagtgaaatagaccatagtgtaggagtacctgaatgaaattgaaaaatataataataagatactaatgctaatgctaatagtaataataataataacaacaatcaacaacattgtgaggatgtcagaggatttccagaccccctgactctggaaccagagttctcaaaacagctatgacggagccatgcagaaccatcttaccgtctgaggaattctgcccaaagcctcagcaatttccatggctttcttctccggaatctctgagaccatggatcccaaagagaaaacaacgatgccatgctccccagaggcgttgacataggcttcaaattcctagagtagaaaaagatatttctagttcatctcttgtccctcacattccttgtgacctaagcacattagattacaagttacttccctcttatggaagtcagtgaaagggtgtgtgcaatagacaagcatcatcatggcaactgtctcctcatcccctgtcaattcaggaggatgtcttacagggttatctgtagggttccctggagatgcagaatccatataatgtgctgacttcccataagaaaagcagaggcacatacgtgagtgtgcatacacctgaatgtacatccatgaacatgacacaggtccatacacatgttcctacttgtggccccacacagaaaacagactctaagtagcatggcagttctcccatgctgtacattattaataagctaactaaccaccaagtgtctctgatggactcagctgtttccaaagaatgtggagaacattagcatgatggtatgacatgccaggctgcccgcagctgaggagctgcctggaacctggtacttttattccctaaatctaaattttcctgggcaaatcatgtcctgatatccctgcatgtaagatacagagagatgactaccaaactctatcatgaacacatgaggatcacaaactctgggcaaccttcccagaggaacagccctcttccacacacctgagggccaggctcttgcatccccctggatcatcacagcagtggcaccttggtctcacccactggacccatttaaagagtgagagaggccaggccaggcttttctgccatggctctggagtttgatctctttaagagcatactagagttggttgctctaaagccctccttgtctaggattgcctcttgttttccttccctcctcagggacttctttcctgggggcaggcagctcacatcctagtgccctttgccttcctgctacctccagatagcacacagctcacctacagtctatctggaaagagatcagtctagttttccctcctgcatggcctcccacccctacttggcagccagtagtgtgtgattggcacaaaatcagctctgtagggtcataaacatccacagtcagatagcaggattcattcgaggcttaactagcacgcaagcttgtgagctacataggcagcttggacaatgactctgcatcaacttttgtggattcaacagaggtgagttccctctacttggcacaagatgccctaaaccttgccacaacatcacagtccttgggacagtcaaacagtgaggcaacatgttagctgcaaataatctttgatctcagacttgtttctttctaaacatgacaagtgctccaaaaggaagaccttctctctacggatacttcactccagctgacgagaccattaaatatttcttacactctactaagagctgcatagttggttctgaactctgaacaaaacatcttttgctctcctagaatccatttagactacctgttagacgcctttcccttgaaccaagtacaagcttgcctgcctccacgattggtctcttttgccagtatctttctatctctggcttctctgatctccttattagctatttacttcagactcaacatgtatgactgtggtccttaattgctttcttttaccaagattgtctcttgctcagacagagggatgacactttgccctactggaagaagagaaagactgcaatatttagttttctgttagaatatctagacattagaatgataacaaggaccataaaggtagtgacccctgccaggatccataagggttaaagaacaattgcatcagacttaagctactagtgcctgaatcaagaacatgagttccaaagggatgcttcgtagtacacagctctgttctctgagaagtgtcccaaacacagtggttcttctgacaattaatgctggctgcattaaattgaattccccaggataaaatgcctaagatatgtatttctcagaatactgtatacaaagaggtaagtcagaaaaggatgccaaggacagacaaattcaagactgtgagacttaggggatagaagttaacaagagagaacacttgaaaccatacaagcctccctgagatcagcacatacctatggaaagttcctttctcccaaagaacaacaggcctggagaggcgccaatacacacctgggataggggctttttctgaaggcaatttataccaccaataaaaaccatgttgggcatgatgggcctggggtaatctttcacaaagtcacttctcatcagccagatagatgcagggctcagaagatcctggacagtcacttctttctgtaagatttcagtggcaagtgacccatagggggaataaaccactctgcacataaagttctctgacacggccaggagcacgttcttcactcgctgtaggaagttcatgcggtctgagttgaaagacaaactcttgggcacgtaggacaatgggacggggcattgggtagcttctgaatccaggctgcatggcaatttattcaagaagtacacagtgggcacagtcaggtactgggccacaatggagccacagggaaggaaagggtctgtcagcagagcatcaaagtgactttcttccagagaggccataaactcggcattgtgcagcaggtgggagcagccagctaggagcatactggaatcccttttgactttcatatatattttgaccacgcgcagcagaaaagaatcttgattaaaggcagtccgtccaagttccaccaaagtagctgtcacattttccttctggaatggcacagggaacttcctcagagtgtaaaatgatccttcttttatgtgtattgaggcttcaggtgctatgaccacaacttcgtgccccttctgctggagctgctgaataactccaagcatactcagccagtggcttccatccatagggaacactaacagcctcccagcgtgggatgcagagggaccgaacacacacaacagaaggtacggaagaagcagaagcaaacgcgagctccagcacaccacagtcatggtatctctctctctctgatgctgccagagatctactcaagctggctcatgacacacgaggagaaacctgtgcaaccagttaatgattgattgtgccccatgactaaagctgtcaatgagctggcaagaccgtggagcatttgttttccatgacatagtgggaggagctttactgagttccttaacaaataacagcaattgaactgacagctactccttcctctaagtagcatgtttgggtgaatatagctggcccaaccatctctggccattttggactcattaaactagcatttttgtaagtcaaaaagggttaacagagagggaaaaaggaccgtaaagtgccaaagcataacactttcccaagaataagactgacagttactcagaaagtcttttggaaagaaaagagcattgtgttgaaacgtcacttttgtccatggaaaccctccatcattcactcagggttcctcttaatcatttccatcatttaaaaaagtggtgtgtggaggatgtggagaaagaggaacactcctccattgttggtgggattgcagaggctctgtacaaccactctggaaatcagtctggcggttcctccgaaaattggacatagtactaccggaggatcccgcaatacctctcctgggcatatatccagaagatgtcccaaccggtaagaaggacacatgctccactatgttcatagcagccttatttataatagctagaagctggaaagaacccagatgtccctcaacagaggaatggatacaaaaattgtggtacatttacacaatggagtactactcagctattaaaaagaatgaattcacaaaattcctaggcaaatggttggacctggagggcatcatcctgagtgaggtaacccaatcacaaaagaactcaaatgaaatgtactcactgataagtggatattaacccagaaacttagtatagcgagatataaggtacaatatgtaaaacatatgaaactgaagaacgaagaccaaagtgtggacactttgctcattcttagaattggaaacaatcacccatggaaggagttacagagacaaagtttggagctgagacaaaaggatggtccatctagagactgccatatccagggatccatcccataattagcctccaagcgatgacaccattgcatacactagcaagcctttgttgcaaggacggtgatatagctgtcccttgtgagactaggcctagcaaacacagaagtggatgctcacagtcaactattggatggatcacagggcccccaatggaggagctagagaaagtatccaaggagctaaagggatctgcaaccctatcggaggaacaacattatgaactaaccagtaccccagagctcttgactctagctgcatatgtatcaaaagatgacctagtcggccatcactggaaagagaggcccattggtcaggcaaacgttatatgccccagcataggggaatgccagggccaaaaaatgggaatgggtgggtaggggaggggggaacttttgggatagcattggaaatgtaattgaagaaaatacgtaataaaaaaaaggaaaaaaaagtggtgtgtgtgcgtgcgcgtgcgtgcgtatgtgtatgtgtgttgtaggctaaagagtaatcttgggtgttatttctcagaggctgtacattttgtgtttgaggcaggctctttcactggagtggagactaccaattaagctacatacagggaggctgccaagcaaagaatatctccctttctctagctccccagtgttgggattccaggcatgcccagttagttgtctgcagaattttcatgtggcttctggggcttaatctcgggtccttatgcttgcagaggattttactaactcagcctctgccactttcttcttagtgaatctaggacagggctgggtttcaagatggcagctgagaccaggggttttcagtgccctgactcagctatgaagagagtcagactctcagctcaaactgataaatcagccctttgaagatacaaatgaatggaaccaggctggggtagaaaatgaccaagaaggcatgggtctgtggacagaagtcctctccaagagttccctcagagagacagtgagaaaacattctaaacagaaaatcaaactaggtaagcaccagctagtaagtacacttgtgctcatcacatttgcctgatgccaagaggaaattctaatgcttgaattgaaggcaacaaaatcgtgcatgctatgtgttaagtgctgtcaagctgaacactctgtaacacatcctatcccatagcactgtactgtaaaaacagattatatatcccttattttagaaacataccgaggctgacaaaagcaaagacatttgccgagttcttggcagagctaagacacaggccctgaatgttggtgcccaaagcctacactcttgacttccagtctccagaagtacccagacacgtctctagtggaaattccacctaggtagaaattgaacgggaaccagggttgtgaacctaaggtcatgaccccaccatgatgaatgaagaaaaagcagaagggaggactttaagcccaaaaaggtgttcaaatagcacaatctggggtacttggagactaggtgaagagctgcggaatggaaatgactcccaaagggagcagccaaagtgagggtaaaacacagcctattactctttgtggggatccactgatgttctatacagttctaggaagaaagccctgatcccagtgttgaacacagtactagtcctacctgcatgtggctgtgctgagaacactaaggagaaacaacttagctttaaagctttggtgttctagggtacacagttgacaggacccttctccttcctcctttttcatgtcttcacccttcctcaacagaattccagttttgcttatgtgttttaaacacacatgccccctacccctgagcgtgcacgcgcacacgtgcacgagcgcacacacacacaccatgcactctgaactcttaagtccttccacacactaaatagctctatcactcttaattattggtcagtggcaaagatatagcaatgcctttgcttctgctgtgcctttaactagatatcaaagctcacaacccaaattaagcttaaggatcagtaatccttgcaaaccccattttgtgagaactcacctgcagcttatgtggggcaaagagcctggaaacactgtaatgcctttatgactctgtgttcctgtcatcattcagaaccttgagcttttttatttatatggtgctggagatagagcccagggtcacaggcaaagcagacagtgtgcttcctcagagcttcttgcagctactaggcacttgaatggttggggcctgtattagtcagggttctccagagtcacagtaacttatggatagtctctatatagtaaaggaatttattgatgacttacagtctgcagcccaattcccaacaatggttcagtagttgaatggaagtccaaggatctagcaattactagtctcacacagcaaacaggcaaagaagcaagagccagactcacttcttccaatgtccttaaattgtctccagcagagtacaccttctagataaagctgtgtgttccaccacacctttaatcccagatgaaaggtgtagcccagattaaaggtgtgttttatcacaccttaaatcccggatgaccttggactcagagatttaatcttctggaatccatagccactatgcctcaagatctccataccaagatccagatcagaaacttctatctccaagtctccagataagggtcactggtgagccttccaattctggattgtagttcattccaaatatacttaagttgacaaccaggaatagccactacaaggtccaaccctatcttggatggaacacagttcactgatcaagatgcaaggcaatctacatctcttatgatcaacaaggagaaccacttcaaaacaatccaatgacaggtcttccctgaaacatgagcagacccaacccctttcaactttaaagtgaattctactgtgctgggtgctatgctaggttccagagccaaaacccaaataaccaatagccacggcctgtaaggagggatccaggagtcagaaaagcacttaaaccaagcaatcacagggtaccacaagatgctttgtatttctgtggaggcccttgttgaatgcagtgtcttcgaaaagtcccatgggagggatttctttttaagctggaaccagaagttaatattcccatctatggaacacctagctccttagatggcataagaatgggtcctgatactaaacaaagcacacaagctctctgccctcctgaggatcaactatggattcttagagggaaaaggcagttttcctcagatctctgcagcattttccccatcctacctctcatcatctagaagttcccacagctgcctatatccagaataaatggatatatttctcataggcagggtttcaaccctgaggccaatccatagctgtgcattcagtaactgtttttgtacaaactccatctacttttactataggcccaatacttaggccaagtgttcactcttagatccagctgctttggtcttatctcagagcttcagcctctaggccgtccttccagcccactttatcagtttgcctttgtattatcccactccaccactgcttctctggtactttggtcaacagctttacagggcccacaggaaaactcaaaccctttagccttgctcttccttagaccctgggtcactttgaaaggagttttcctcctctttggctctcctgattagtcaaatccatctaccctttcctcctaatgaggactctattactgtttattgcatgtttaccaagtgccaggcctagaggttcaagttcagtcactgggcgtgacataaactcaaatgactgttctggcatactagaatttctgattagacctagtacccttcatgatagaatctttaaacatttactggttaaccatttcctttagaactaagtaatctttagagatacatgttgcctcaccactgatcaaataaggtaatacagtggtttttgtttgtttgttttttaaaaaaaagccctcaagaaagtggggataaaagcaagtgtcaagcaaaggcagaaggaaggccagagtcatactacaacagtattagtggcaacaagaacatttcacctaaggtgcttcaaaaacagccacaagttccaattatttttgttcagaacaacaatggttctccaagtataaactagaaccctgaagatcccccaaggacctttcagaggaatgttacaaggttgaaactatttccattaacagaaatattaacttttaaagatctaattttctcataggcatatggtggagttttccaaaggttactctatgagatcaaaatagattgcagaagaatccagctctatgaagcccaatgctggagtgatttgaagaacacaaacacacatcacccttctgaagttttgttttgaagaagttattttctcagaacatgttttatgctagtgtgtatttaatagatatgtttttcattgctttactttctcttagagccatataaatgaaagggggggggatgtcctatggccaaaaatgtttaagaacctgagtccttcacaagccactgtccttcagaccaggctcagggtcagacaaaacataatcctgacaaccttcctaatttcctgcctggctgacgaaaagacagcttggggcagggcacaaaaatccatttaaaaaatccagttttgtgaggcacacttgtgccacaatgcacgatgctgaggcagcagggcattactgcaagtttaaggccagtctgagctacacagccggggagagaagggcgagcagcatcaggagaagagggaaaggagaagagtgaaaaaaaggagaggtagagagaaggcgaaggtgcggggaagggtgaaatagtacttttctatagcagccagagtcaaagcctctctcccctaagtcgtcctttgttcgccctaccataggacaacccaatcaccactgcaaggatactagactcggtcctgtctttaagcgtcactgagcatctctgggagcacaacggatccctgggccctccattctgataggctgaggcaccgcccgcctccgccaatgagagacgtttgcgtcacaagggagtgtggcgccggccggtaggcgggcgttcagcagctgccaccgccgctccagcgccgaggccgcgggccggccagccgccatggtggactactacgaggtgctgggcgtgccgcggcaggcctcagccgaggccatccgcaaggcgtaccgcaagcttgcgctcaagtggcacccggacaagaaccccgagcacaaggaggaggccgagaggcggttcaagcaggtggcgcaggcctacgaggtcttatcggacgtccgcaagcgcgaggtgtacgaccgctgcggcgaagtgggcgaggtgggcggaggcggcgcggcgggcagcccgttccacgatgccttccagtacgtcttctccttccgagaccccgcggaggtcttcagggagttcttcgggggccacgaccctttctccttcgacttcttcgggggagacccccttgagaacttttttggggatcggaggagcacccgtggaagcagaagccgaggggctgtacccttctctacctcctttaccgaattcccaggatttgggggtggcttcgcttcgttagatactggattcacatccttcggttctccaggaaactcgggcctttcttctttctccatgtcttgcggcggtggggcggcaggcaactacaagtcggtgtcaacctccaccgaaataattaatggcaaaaaaatcaccaccaagagaatcgttgagaatggtcaagaaagggtggaagtggaagaagatggagagttaaagtccctgataattaatggcaaagagcagctgcttcgcatcaatactcagtaaagactaaagtgtcttttaaggactatcaggacttttttgtttaaacgcgttttcaagggaactctactttcagaacaactgtattccagacattatatgcagctcatgtcggtgcctcttgttattgttgggatcgcagggataggatctctcttggtctttatgcctgttgtaaatatctgtatgcctttggcacttattaaacttaatcctgaggcagaccactgttatgttctagtgctaggaaacactgttcacaacacctaaaaccacacaatctccattttgttgaacattcgactcagagctttccttgaactttatagctccacttccccacatgcgcaccaaggtgaaagatgggcatatattgagtctttcgtttaagatagctaagttgaaaagagtggcttttagtttacctaaagtcatgctgacataggaacagttgactactgtttaaatgaaaggctaaaactaagcagctaaactgaagaaagtagacttaagtatattcttgttattgctgcaacaaattaccacgaacttggtagtgtgtatatcacacttattcttcccatgttttgtagaagtctgaaattcacttcaatgggcaaaaaggaggattcctaggatagtgctctctctgaaggtttggggttatgtttatcagtcaaggtctcaacatttggctggttagtgcctaagtttgttctacaacagtggaagatgctggaagtgagaagtgccttttgaaggatatacaagctccttggttgtatatatatatgcaatagagtccattctataccacagttgggtgcttcctagacctcgcagaagatgttgcctttagagaatacaacacagaataatctacctcacttcagtgttatttaggaagacttcataaggcatggaagcaaaatggatcggaataggttttagatgccatgctttgtaattctctccaaagaggtcataggacctaagcacattatcataaattcagactacacgaaatggcctagggttttcagtgcttactaggcaagcatccccagaatccccagaaacctaaaggtctggtgtgtgagatagtcctcagagacacgaggtccccagagcatgctggccggcaagatgagccatattggctaagctctggatttttttttttttttttttgagagaccctggataaagtgcaagagtaattgagggtgattcctgccatcagccttggacctccatgtgtgcatttgtgcacacacacacacaagacacacacaccatgcagacacatatgcacatacataaggaagagtcactgagtagtatgttggtatgggtttgtatctgaactgatagaaggtatcaaggatttggggataatgaacacatacagttgtgtgatgattaaatgtggaaatcatcatcctgggtgggacatgagtggatctgaaactacacagtggataaaagattgtcaggagagtttctgtggtaggcaaagagcctggcatagcaaggttactcagagaccatgggtcttcagctctgttttaaaagttgagagcaaacacaagaatcaatagtcatctagatgtcttggattagtgctactataaatgtaaagttcctggttggactgaaactcattatgtaggtcaggctgtccttgaactcacaggaatctactctgcttcctaaatgcagggattcacagcatgtgcaaccaggcccaactataaaaaacattttttaaaatgaattgtcaagcttgaaactttcttcaaaaatggctttgtctcaaaacacttgtgaagacattcattcctgtagaaggtcaccttttagggaaggcttgtcatagtggtcaaaaggcatttcctgtgcctcttgaatccacaagtagatctgtgtgtaaaagcatattccagtacaagtctgacattttgactttgattcctgggaacctaagatggaaggagtgaaccagcaaccagaagatgaagttcttgacttccacacaagcaccttggcacacatgcacacagcacctagtttttaaaaaggcattcaaatacactgtaggatattctctcatggtatcactgggagcatttttctagaatacaccagacaaggaaggagcaacacactgtaagctctagaagactaggaggccctgttccacctaaaacaagatcgactttaaaaagccagtcacacggcgtgaggttcacatgcagctttagcgtagtcgacatggctgaaagcattcaaaagaaactactgtttccaagtaacccctttctctttgatttgatgtcacagcctccaaatgggacgaaaggtaccctctccattgtaggaagtcattcatctgtatcagcttccactcttagaatttcaaattctacattctcagttctctcctctctcccatactggccctcatctcttctttatcctgccctctcttctccctccctctcctcttcctcttccttctcacttcccctctcatgttttcattatttatccttgctccagcttcattatgtagccttgatggacttgtactaatcctaatcctgccttatctttcaaagttctaggattactaagccaagctcacaggtttcctcattaaatacagactcatttaacttccttagatctccattaaactgtttgagtatatgttcaattacttcctgacaatctgactagactgggaaataaccagtagcctcaggagtaaatgtacaacttactttctacctgtaccctatgatagagtaaaaagttttgttatggtagacttatctagactatttttcttttagctttctatatacaaaatttgaaatagacaattttgttatatcatggaagatctatcatacaggagctgcgcagttacacacagttgactgagcatttgatatgtggctagtccaaaaattgatcctataaactaatgattctcttgcttccagatctgttgagtgctcaagtgttgtgtgcatagcactcatttcacctctgagagcaatattaaaagctttcacatcaacaactacaatttgctgattcctttaaccttcagaaaaaaatctgaaagcagcacaccttctggtgggtcaggccacagctcaatttctcagctcctgagcagaatcaggacactaccaatagcaaaaccatgtctggatatgtgggcaatctctgttgagtctcactccagcacctcagaactaggcccctcaccttagccttagtcccaaagtatgtcatggtgaacaccttaatacgttaatttaactaaagcctctcaggaaagaagagatacctttggaaagatgagttggataaataagaatttgaaagtaaaaaataatttccctggaaaatccttgagataaaagcagaatacagacctgagagaggggcttcttggtaacacagtttatgcccccaatgaagaccatgttaggcatgatgggcctggggtagtcgagtacaaagtcccctcggaacagccacacggatgcatggctgagaacctccactaaggatacttctctctgcaaaagctcagaggccaggctttcatagggagtgattgataaacggcaaatgtacttcaggaccagatagtacagcatgttctggaccctttgcaggaagtccatgtggtcagaaagccttgtgagtaggttcggaatataagaggaaggatttggacattgtgtggcctcatattctatgccacaggaaagagaacgcagaataaacacagcaggaatctgtaggtacttggccagtactgctccacaggggaaaatggggtctgttaagatcacatcaaaaaaactggaattcagttgctggatcagcatcttattgtgcaataaagctatacaagaatttgagtagaggtcaaaaaagtttcttatagatgctgtagtttcaaaaaaggccttcacaaaatgttgtgttttaaaggtcttctcaatgtcgctcagtatttcttgctgatattcttccttggtatatggaaaggcataggttttgagggtgaagaagtcttctcctttgatgtgcacagtcacctctgaagccaggaccacagtctggtgacctcgggcgtggagctcccgcacaacatccctcatgctcagccactggctgccctccatgggtaacaccagcacttttgcaccttcagcccagggcagggcacacagcaggagcagcagccctgagattcctcgaaggggcacacatagtcccgtgtccatctccaagttctgttctcctgaatgctgagggctgtaggatcctgcacttagttaagggacctaggtaaacattaatctgggttttcaccgcattctgaagttgttggtcaggtctccttctacaatccatgtcagacaagaatcctgataaagtcggaattctcctatgtagtaagcatggactacaatggttttttggttttttttcccctgagggcactgggctgaaagtcaagaaaagatgaatttgaggcccaggtcgggggcaggactccagggttaggcaccatgtgcatgaccatgaatctggccctgcctcagagaaatcctcccacatgtgatgaacagttgctgccacctcctaccttcacaaactctgaggcatcactctctcctgggcaagcccctggggtgtcctgcattctgtctctccatatcagtgtcattctgctgtgccagccaggctcaggctttcctctggagagaagccacgctctgaggatccagacctggaactgactcagggtgagcccctgctgccatgtacaatctgcctctgcatttcaccctttcatgaagggcaggtgtttagaaaaatgttctgcagtttctcttccaaaggcaatttttcagcctttttgtcctgcgcctgcctcttctctgcatgttttatctcaaggcaaaccctgtcatttcccttctgtgtctgtctatgcagaattacccaagtgtaggttttagcctctcctgtccatgccatgcctgtaaaaggaaacgaacagaggaagcaggtggctgagaacacagaacctgaatctgtgctcgctgcttgtcgccattgttgtcagcctgaatggggacactcccaacactactgctagtagaagagccccacttcttcccagactcacgatgcagctcctttgcacctgtgctagtgaaaactgaactaaggcaacattgattgttcccctccatgtgagggccaggcttgcagatctaaagcacagaagagcccgataccaagtctgagcaatgtttctatgtataaactaggtcaaagaaatactgctaattctgctgaccaagtgccagaaatgtagcatgtatgtagcagaatgagaagcatgaagaggcacacgtggcaaagactggccctcacaatattcttgtttcccgttttgttttaaactgtcaataggtgcatggtgccttgggtatttattataattaatgcctaggcaaacagaactatttcctggaactaggaaatgatgtttagtgcagcactgtgatccctgcatttgctctgggctggaagtgtgcagggccaggtaactagcattggacacttcacccatcctggtgaaacacatgagcactttttttttcaattttttattagctgttttcttcctttacatttcaaatgctatcccaaaagtcctctataccctccccccaccttgctcccctacccactcactcccacttcttggccctagcattcccctgtactgggacatataaagtttgcaagaccaaagggcctctcttcccagtgatggctgactaggccatcttctgctacataagcagctagagacacgagctctaggggtactggttagttcatattgttgatacacctatagggttgcagaccccttcagctccttgggtactttctctagctcctccattgggggccctgtgctccatccactagatgactgtgagcatccacttctgtatttgccaggcacaggcatagtccatcaagagacagctatttcatggccctttcagcaaaatcttgctggcatatgcaatagtgtctgcatttggtggctaattatgggatggatccccggatggggcagtctctggatggtccatccttttgtctcagctacaaactttgtaactccttccaagggtattttgatccccattctaaggagggacgaagtatccacattttggtcttccttcttctcgagtttcatgtgttttgcaaattgtatcttgggtattctaagtttctgggctaatatccacttatcagtgagtggatatcatgtgaattcttttgtgattggatttcctcactcaggatgatactccccagatccatccatttgcttaagaatttcataaattcattgtttttaatagctgagtagtactccattgtgtaaatgtaccacattttctgtatccattcctcagttgagggacatctgggttctttccagcttttggctattataaataaggctgctatgaacataatggggcatgtgttcttattactagttgtaacatcttctggatatatgcccaggaaaggtattgctggatcttctagtagtactatgtccaattttctgaggaacctccagactgacttccagagtggttgtacaagcttgcaatcccaccaacaatggaggagtgttcctctttctccacatcctcgccagcatctgctgtcacctgaattttttatcttagctattctgactggtgtgagatgaaatctcaaggttgttttgatttgcatttccctgatgattaaggatgctgaacatcttttcaggtgcttctcagacatttgatattcctcagttgagaattctttgtttagctctgtgccccattttttaatggggttatttgattttctggagtccagattcttgagttctttgtatatattggaaattagtccccaatcagatttaggattgttaaaaatccattcccaacctgttggtggcactttttgtcttattgacagtgtcttttgccttacagaagttttacaattttatgaggtcccatttgtcgattctcaatcttacagcacatgccattcctgttctgttcaggaatttttcccctgtgcccatatcttcgaggtttttccccacatgagcactttcataacatgcttaagtaactttgaaataatttacttgtacacggatgttgccaatgtcttaatagttaaccatcaatcttggctaaaaattaaatcttgcccttttaaaagtaaaattcctgacaaaattggaattcttagtttttaattactctcatatcaagtcataacatactagatgacttaaattcacatttaatctctgcatggtttggaagccacacagctatgttaccaggaccacactttctctgaaggccaaggacaaaatagttaagcacatatcctaagatttggaggttgaccggtgggacgtcaggaatggccttagttgcaacttggttctatattatggcagatgttgttaatagaactgtttcacaaaggctatgcaaacctctccattttcacaaagggcacactgattaaagcctaacaaaaggcagctttaaccctgagcattttaaaataaaatgggaaacaagaatattgtggggatataaatgctataaatctaaacaagccaattacaacagcacagtctatgtctgatgtaaagggcttctgtggcatgtagccttgggagagcccagcaccaaatactgcttctccgtggttattggtatgggtcgagtaaggtctgaaagaagcaggacaaatgcgatagatcaaaacacaagtttttaaaccttggtagaacattcacaaactgggatataaaaatggctttggatactggtcagtgtgcttaaagtgtgaaataaatgcaataacacacacgcacagggagagggagagggggggaggggagagggagggggagggggagggaggagactctttgtattttaccatttcaccttgtatggaaagtaggagtccaggtaaatgctgtgcaatttctccttcaaaatcagttccctgctttcatttctgcatctgcttcctacacctgccacctctctgcatgttttacctcatatcaaaccccaccgtttcccttctagggctatctatggagaattaactgaggctgggcagtggccactcctgtccattctgtgcccataaaaggaagggaatagagggaacaggtctgatgagaggtcaggccctgaaatctgtggttgctgcctcggctcttgctcacagcattagaaagaacattccccatgccatgtggagtggaagaggaagccacttccttgagaagggaccccaatctcctggtcaggctcagtatgcacctcctgggtacatatgattctggaggaggcctatggaagagaagagcacggtaatgttgatggctcccttcactgtgagggtctgccctatgctcagagcccaagagtacctatgagccaggtgccaagttttaagaaattgtatatatgcaaactaggtctagtgggtaccatcagctctgctcactcagagacataaaagtagctagactcacgaagaagcatgcagcaaagattggacttagaaatattctttaaaacttttgaaacagtatctctacttgctgagccatctcactagatgtaacactagccttgattccactgttgttttacaatgttgaagatgtgtgtgctgcttcacatctatgaaagccaccagccacacatgccctacatgggcatcctgtgttctgagctatccttccagagggccataggagctcacctaccttaccaggctctgattcccacactagtttaatcatcatcttatctccatgctccctaacattcagcatgtcattgtgtggcacagtgccctcctttggttaatctttgcagaataagttcaggttcagttcttacccttctgactctgcacaatgagaaaccactcttatggtctctgctagtaaaacttgtgacctgtggctgtcctctagcagacatcagagttcacctctcttctccgatatccaaaacaaggttctgcacactcaattgattttgtcacatctttctttgtcagccatttaagctctgtagtatgtatgagaatgagggtagttagtatgagaatggcccccttaggctcatatatttgactgtgtggttcttagttggtggaattgctttgggagcaattaggaggcatgaccttattggaggatgtgttactggaagtgggatttgaggtttcaaaagcccatgccaaacctagtcagtcagtcagtcagtccctctctctctctctctttctctctctctctctcctctctccttcttctctctctctctctctctccctctctctctctctctctctctctctctctctctctctctctctctctctctctcttcccttcaccttctctctcttctctctgccttcaactttggataagttatatactctcagctactgccccagtgccatgcctgccagccttcctgccatgatcatattctcacactctgaactattaacaatccccccaattaagtgctttttaaaataagttgccctggtcatgatgtctcttcacaacaatagaaaagtaaccaaaacagttggtgcctactgtaccctctgctagacctgatgtactcagaaacacatgcagggttcttctctctgcaagctgtgtcagtacatcacagagcattaataagtcagctttgagaaacaaagaggttgctggatctccatacaggtgcatttcctgtgctgtggcataactgtagtaatcagggaccacatgttgcatatgtctggccaacgccaaatttctgctctcctaggtgctgagggctgcatgcttctgcactcctttaaagcctctgggtgtacactaatctgggtcttcattgcctccttctcctatggattctggtcagcctccattttacagttttgacagctcaagattcttacaagattggattctctgaaatatcatgggccatgatcttgtgggacactgtgctcaagtgtcaatttggcaaagcaaatttgagatgcagctgagggcaggactgtagctgtgaggactgtgtacatgatcaggaatctggctctgtctcgaggaattgctctcattgagtgctaagcagttactgccaccccttcctttacatgccctaggactccactctccaccaggtgagctccgcttgggtaccctgccttccacacacacgtgtctgtctgcccatggttgtccaagttgagatttctctctgcagcaaagccacatccttagtatgttactggcagtagactcagcagctgggcagatgtataaatgaaaatggctcccctgtgctgctaccacactgtataagaagcctttgcatatcacctttcatggaaggtaggagtccagataattcctatgcaatttctcctccaaaattagttccctgctttcttatcctgcatctgcttcctacacctgccacctctctgcatgttttacctcatatcaaactccaccgtttcccttctatggatatccatgcacaattatctgaggctgggctgtggccactcctgtccaggccgtgcccataaaaggaagaaaacagagggagcaggtcttaaacaaaatacaagtagcctaatagaatgggtattattggattcctatcattactctaacaagtcattgaaagagagctgactaatgctcttgatgccttagcaaagaacatctcccagctttgaatgagatccagggctcattcaaatggattgactgctgaagacaaagtaatgacaccagaatgaagctcatatcctaattcttagaacctgagacagtgttacatcacatggcaaagagatgatagctgtccttgaggatcttgaagtagaggggctagttcatatggctggtctaatatcgcaaaagaacttgttagtaaacaaaggaaacatggaagagacaccatggtctacagcccctccatcaagagacaaagtgctaccaaattacagatgtaagatcaaagatggaaattttaaataatcatgtaaaagggacacgtttatactaagtaggagaagtcaaatccaatccaacctatctgaataagcagaactcgtacaccaagggaaagcaataggagttgagttttaaaatactgtttaaacgtttaaccaaaattcttaaaatacttaattagaagtaaaggtcagagtaatatgaaaatagcataaatcggtgagattgcaatctgataggtgggatataaaagatgtcacttagtgctaagcgcctccacgtagaaatccaacttccatatttacagggtaacaactatttaaaaatgctaatcaaacctctgcaaatattggtgacaagatgacaggaaatagagggtaaaagatacctccttgggaactaaggaatctcaggaatacattacacgtgcagaacgtaacaacgtgacagtttggatcatccacaggccatttagaaacattgatcacacagcaatgccatgaatctggagcattgtcatgactagtaaaaactgaggtgagatgtaaacaaaattacatgctaggctacttctgcttctgttctcaggcaccacttaagtacacatccagcccttcccagagagaattgttaaggactactgggtaaaaagttccttcatcttgctcactgcctgctgtagactaaggaataccccacactggagccaacatatgagccccagaacatctgagagccaactcggcttctctggtcctgcccaggttcaggagatctcatgtctaggagatactgtctttttggtggacacattctacagggtaccagcactgctcaattagaggccctaattattgcctcttgagattctcaccagacacaaaaatcctgttataccaactatgaatgccttaaagatttgatacaccaaagttcctgggaagatgagcaggtaagtgagcaactcataacgagacatggaaaccaatgttgctggaccactctttgcatgaaggcccaatacagacctgagagagtggcttcctgctgacacagttaattcccctaatgaagaccatattgggcatgatgggcctggggtagtcaaatctgaagagccatatggatgtgtggtgcaggatctccaggaaggacacccctctctggaaaagctcagaggccaggctctcatagggagtgaaaaaaaatgggggcaaaagagcttaaatgacagaggatagatgttcttgactctctgcaggaagctcatgtggtctgaattccttgtgaataaccttgaaacataagaggaagggcttggacagggagcagcttcaaactcagcatcacaaggcatgaagcacagaaaaaacacagcaggaacatgcaaatacttggccagcagcgccccgcaggtgtacacagacgctggattaaacccttgctgtgcaggagctctatacaaattctcaagtagaatgttgacagcttttttgcaatttttgaatctcttaaggtcatagttagaggatcttcagttgtaagcaacatttgaaaggggctcagcaactgttgctcatattcttccttggtgtatggaacagcataggtttgcagagtgtagaagtcctcttctttgatgtacatggacacatctggagccagggaatggcctcaggcatggagctccctcacaatggttttcatgctgagccaatggctgccctccatggaaaacacctgaactttcccaccctgagcccagggcagggccagagcaggagcagcagccctgagagtcctcccagaaacacatggcttccagtggccatgtccagagaagcaaagagcagaggattttccttgcctgtctgtctctatctccaacatgagtttctctatcttatatcaccatcaagtgactttgtaccatgacatgtcattagtaggtgcaatgttttccttcaattaaatcattgaataattaatccatgcctggccttcagtattatcctaaccttctggctctattcagagaaaacagacctgattgattatttactaaaagaactcttgacacctgctgttgctctctgacgaacctcacagagtcccctttttctcctctgattttcacaaaaatgatctgcacaatcctgacttttttttttctctgtccatcatacgtcagcaggatgctattgggaagtgcctgatgactgagcagctgctgtaaccaccccattaaacacgacatactcagtagttctttgaggtctctcttagtattctcaagaagcactcagtgaggcaagctaggttggtgcatctctgacaatgtaactgcatgatcagggacactgtatttgaagtgataggtggttatctaataagacaatgctggaaagatcttgaattcataacttggggatgggattccactgaatggtcaactgagaattctctcagctcctcataataaataaagcagatgctgtgtggatcacacttgagcaagaccagcctctacatgaatacaatgtatggaggtggtgtcctgctccagtgatccactccctttgggactagaagcagaaagacaatgttctggggtctggctcagtatgacattcagttctgcttaattcggagggctgtacaaatctgcctactctttagggatatgggcagaaggcttcttttaagccttcagcggatcttgagacttataactgcagctctctcaccattcattctagctatgagttctgatatggacaatatctatcatatgaacatcatggggtacattttggtgggtcacaatgttccattttccaaatgcagaaagcaaactcaaggactaggtgaggtactaggtacatgcgctaggcagaatttctattgctgcaacaaaacaccatgaccaaaaagcacattggggatgaaagggtttatctggattccacttccacatcatagtccatcgctggaggatgtcagtacaggaactcaagcccaggatggaacctgaagacaggaatgcagaagccatggaggggtgctgcttacgagcttatttcctatagcttactcatcttgccttgttatataacctaaggctcccagcccatggatatcccacccaccatgggctgggctctcctcaatgatcactaaataaaaaaatgccttacatctggatctcatggaggcattttctcaaccagggctcctttctctgatgactgcagcttgacacatggaaccagccagtacaagaaccttgtacatgacaggcaatctgttcttgcctcaggagatttatctcgggtgtgctaagcagttttttacagttttctaatttacttcatatttatctttctgtcctgtgtgctcagacaggacctagatagagatcttcattcagaagaaattcaaccatcaggcatatgagcctatatgcatggcgcttccactgtgccactgacgtccagtgcttagggtcttatatatccctaggatcaagaaaactccaggaaaaaaaattccattctgtcttcacaagccattgctctggtctttttctctggattgtctttgtgtctctggcatgtctatatggttatgggtcatcagtctctgacatctatatgcagtgaaaatctagtatatctcttctatggatacccacagaaaaactctgaagttctagcttcctttcctacataatggtcataaaaataaggacatggatgaagcagttgataaactcatatttagtatctcattgtgttggaggatcaaaatgtgtctctgatggctgaaggctgccacacccactccagtgaaggctgtgtgacaaacctaaaagcctggaagcagtccctaggcaaagagtttcatggaaacttaacctcctggaaccttggcattctcatagaatgtatgctccgaacctgtccccatgttagtcgggtgtatggatctgtgtactttctttcagttttgttttattataagtgcctttgaggattggatttgacatacggctaagttagattagcctccaccagtgttccaatgtcctaggcagtctttgagctgactctgaacttggaattcagtaagaatgttacctattcagtaacattcaaaattatctctagtagagatagtgaaagtaatcaggcattacaatttacttaaatagagctagaaatctcagagctagtctacatagtaaatacttaaaacaatagccgagtcactcccatacacaggaatttacaatggcctaggaagaaggtaggttgtggttttaggaggaactgaagtattattcatgaaagggttagtagaacagaattcccctggtgcatgtttttcactaggcccagaggaatagcataatcaggtatttactaaaggacccctggtagtgggtttaacaatagactaacattgcatcagaccattcatctggctcatgtgtttagctgatcttagatagggctgttactatctcagttgtaaacactgcctggatccctgtagctttttatgtatgcatttttctttgttttgtgttaagaaccgttataccttggcaaatgtattcgcccagcttttttgtttttcttctgtattataagtctggtgcttgcttttgagaaaattacattcaggtacaacactcccttgtgtctgtgtctgtttgtcacactttttgccaactcctgcccacctgtaacggaaccctgagttctcctgtggaggggccaactaaggtcagtctgcagcagaaggccataattctacatcaaccccttcaggttccatgttggtcagatacatactaggctagtatttggccctaactagattccaaaactatgataaatgttgacaataggaagaagcttttaaataagacctcataaaccctcccactgttattaagtcataaatataagatcctaaggccaaagagtaccagtgagtaacatgtaatatacagaaagaacagggactgagctatgtgttgaaggagcacacaggatctgtggaatcctcaggcagaggccagtcagggaggcaccttgccaaccatgctgtacataaaaaccagaataaaactttgggaatgtgtcttcatttattccctggacattaactctcagattgaggaagtcagtaatctgaatacatgtcatttagtagtaagataaaagctatatcatcaaaatattatttaccttggtccaccaatttaactgccacatacatgtccagggtaaaaccactgaaatgcaaatggaacttaagcaaataccagcactagacatttacttgggaactgggcagattcagacacaagttttgatgcacaaaacatgaatgtgtgccccaagacattcacaaacagtaaccatgcaacaatcacacgactgtggagtacttaaaatgtggcttgcctcaaggtaggcaggctataaaagaaaaagacccatgagattgctcccacattgactgagtgaccaggtctcttgtgagcacacagcacccctacccatcgttgaagactatcatgtcaacaactgctacttgctagattctctgtctgtctctgtctgagaagaacacaccttgtgattggatatctctggtcctcctctgattcaggaaatctcatctccaggaaggcacagtctgctagtgggcagactcagtggagttccaccatccaactctcctcagtcttattagagaccttgagtactgcctcccagccctcagtgatcactaacaacctgaagtagcaactctgaatgccttaagaatttaactcaccacagacaatgagaagaattttaaaaaagaaagaaagaaagaaagaaagaaagaaagaaagaaagaaagaaagaaagaaaaagaaagaaaggaaggaaggaagggagagagagagagagagagagagagagagagagagagagagagagaggaaaagaaaaggaaaagataagaaaaagaaaaagaaaaagaaaaggaaaaggaaaaggaaaaagaaaaagaaatccccagaaaagtgagtgggcaactgagcaattcagagtacttttacttttgtttgtttattctttttaacacaatcttgctgcaaactcatttgaataaagactgaatacagacctgagtgagtggcttcctgttggcacagtttatgcccccaatgaagaccatgttgggcatgaagggcctggggtagtggaacacaaagtcctttctcaatagtcacacggatgcatgtctgagaacctccaccacggacatctccctctgcaaaaactcagaggacagtctctccaaagaaccataactaacatggcaaaaatacatccatggcaaagggtaaaccatgttcttcactctttctaggaagctcatgtggtcagaattcctggttagaaacttgggaacataagaagaggggtttggactgcttgttgcctcaaattctagttcgcagagcatggattgcaggaaaaaaatagcaggaacgcgcaggtgcatggccagtactgccccacaggggaaaaagggatctgttaacaccacatcgaaggaactggagttcagatgctggatcagagctgtgttgtgcagcagacccatgcaagatctagtatagaatgttgatatattatttacagctgccatattctgtaaaacaaacttcagagaaaattcagtttcaaaaactttttgaaggtggcctagcaataggtacctgtactcttccttggtgtaaggaacggtgtaggttttgagggtgaagaagtcctcttctttgatgtacacagtcacctctggagccaggaccacagtctggtgacctcgggcgtggagttcccttacaacatccctcatgctcagccagtggctgccctctatggggaataccagcactttctcaccttcagcccagggcagggcacacagcaagaacagcagtcctgagagtttttgcaggaatacttgaattcccatggctaaggatggagaagtccacagcagtctaccctgcttacatgtctatgccacttaagctatttcctatcttcttattcccaagtccatacgttaagtcattgggtggcacagtaccttccttaagttaatcattgctgaataaacccatgcctggcttttattatggccctaactttttgccttgataccaaggaacaattttttttattacctctctactaacaaaaccctgtgatgtgcaactgctccctaggaccatcagagttcatttcataaaacaaacaatgtaagatataaagatggcgattaatcccaagacaaaaatgggtgacttcagtagcccacactcaccaatatacaggtcattctagctagaaaaaaaaatacacaaagatatcacctaaatggcatcataggtcaaatggatgagagatctgaagaacattgcatccaaacactgcaggatacacaatattctcagctgtccctgtaactttctctaaattaaattatgtaataagacaccaagaaagtcctaattcatgtaggcaacctgaagcaatttttggtattctacctaaccacaatggataaaactagcaatcaacagcaagagaaacagagaacacacacagaatcattgagactgaacaacacaagactgaataatgactaagtcactgggaaaaccaataaagaaaattaaaagttcctagaatgtaatggaaaaggagacacactttgccaaaacctatgggacacacagaaagcagtcctaaaagggatgttaatacctacaagtttatagctacctttaaaaaaattaaagagctcccaattacataatgggtatactttgtgtccttgaaaatggaaataagctaaatctcaaattagtacaaggtaagaaagaaataagttcagagcagaaagaaatgaaatataatttttaaaatatttcaatcaacaaaacaaaaactctgttctttgaaaaaaataaatataataagcaaatcctgagtcaaactaaccaaagaaaaagaagacctaaattaataaaattagagagaaaaggaaagccatgatcactagtaacaaattcagaaaagtatcaagtgtaactcagaagcttatactccagtaagttaggaaatctaaaagaagtagaagaatctctacagggagtcgcccatcaagagtaaaccaaaatgtcagaaacaacttgaacagatctacaattagcaacaagattgaagcaggggtaaaatccctcccaacaaaaaaataaaccagaactcagctgaattctatctgcctttcaaagagaagggaacaccatgctcctcaaactattcgctaaaacagaaagggagggggcattatcaaagttttttcagaaaatcagcattactctatgctaatcagcattactctatgctaatcagcattactctatgctaacatacaaaaccagaaaaagatataacaacagaaacaacaacaaaaaatttaaaagccaggctccccaatcaacatagatgtaaattttatctataaaatacttgcaagtgaggtcaagaatatatcaaaagggtcatctactattatcaagccaacttcagtccagtgtgcaaatttggtttgacctagggcaatcaataaaataaatacagtacaccacaaaagtggattcaaggacaaaaaataaataaatcacgtgaacacctcaacaggtgctggaaaagtttgggggaactgtagcatcctctcacaacaaaggccccaaagaaacttgggacaaaaggaactcatatcaacacaataaaggctgtgtatcacaaaactgtagctcacattataccaaaatctggaacaaacaacggtgccttcttttcccattcctattcaatatagtattcgaagtctggttagagcatcaagacaagagaaaggaataaagtaggcgcaataggaaaggaagaagtcaaagtgttgttatttgcagatgatattgttctgtatatgagagatgacaaagactcccccagaaagctgttaaatataataaacactttcatcgccgggtgatggtggcccacacctttaatcccagcattcgggaggcagaggcaggcggatttctgagtttgaagccagcctggtctacagagtgagttccaggacagccagggctatgcagagaaaccctgtctcaaaaaacaataataataataataataataataataaataaacactttcatcaaaaaaggtaggatgtaaactaacataggaaattagtttccttcgtatatatcagtagcaaatattctgagaaagaaatcaaggagacaattccattaacaattacctcaggtgaaggaaccctacagagagcatcctgggggagaaactgaagaagacactagaaaatgggaagatttctcatgctcataaattaaaggagttaatattgttaaattggctttttcagcaaaagccaaattcaatacaactcccataaatttatagtgccttttttcttttacaataatagaaaaaaaaccctcaaaacttttatggaagcactgaggatccttattgggagtaatctttcatacattgtgtgaaggctgtctctgtatattcaatcgttgattgctggaccagcagagagctgagtactggccaatcttggtattcttatttctatggcccatcactggtctcatattttgtaaactttcctccttcaccactcacctactggatctaataaagaactgacagataacagctgaacaggaagtggaagaacttgcaggaagagatagggactctggaagaagagatgggacatgggcattcaccagcagacatggagaggagcagatgcagtggagatgcagagaggtacagagcttgatggaccgtaggctagtcagtcacgttaaggttagatagctggctaggagactgccggagctaaaagacctaagcattcaaatattaaaagactccatgtcattatgtgtatagctggtgggtctgagaaagttcctctagagagtctgaagagccaaagccatcctgagcagaaggaataatgctagaggtatcaccacacctggttttgaatactaaaggaccacggcagtaagaatagcatggcaccagcacaaaaccagataggcggattaatgtaacagatcagaggacccagacatgaacacacatctacagatacctactgcttaacaaagttgtctccaatggacattggagaaagtggggctttttaaaaaaactaataagtctgggaaaattagaattacacatagaaaaatgaagctggatccatatctctcaccctgcacaaaaaaataaactgaaatggatcaaacatcttaatgttacaccaagaacttagaattactatagggcaagatggcaagaaaaaaaatcccaagaattgacaaatgggatcttataaaactggagctctgaacagaaacagaaataaccaccagaaaagagacagccaacacaatggaaaatagtccttgccaacgacacattgacacattagtcaggagaatagaagggactatacaacataaacaccagaaaaatctaaatcatctgatgaatcaaaaggctgatgaagtgcataaaaccttcctcacagcatctcagccagaatggccatcaagcaaacaaaagaaaaaaacatgctggagaggattcagggacagaggaagtctcttcagtgctgatgggatataaacatgtgtggtcatgtttacagaaatcagcatgaaggttcctcaaaagtctaaaaattggccaactatatgcccgaagcagcagcactcagggtgccaaggcaagagcttcctctgagttcaaagccaacaggtctacatattgaaaggatgtctaaaaacaaaacaagacaaaaccatgaagtagaattatcataggactcacctatactgctctgagtatgcatccaaagagctctcaggcaacttatcacaggaacgcttgcaggcacacacctattgctgtagtagctactacagaaaggaatcagatcagacagcatgcccagaacagataaagagctaagcagataaagaaatgtggtacatatacacaaagagcttttattcacacataaagaaagataaattatgacatttgtaggaaattgatgaaatcataaatcattatgctgaggaaaataagccaaattcagaatataaatcttttttctgatatgtaaaaacttgattttgactttctctctctctcagtgtgtgtatgtgtgtacatatgtatgtatacatggatatatataagggtgtatgtatatataagaatggatgagtatatgtatgtatgtatgtatgtatgtatgtatgtgtgtgtgtatgtatgtatatatgctatgtaagacacaaaaccaaaatgaggattatgagacaggagaaaagtcctaaaggaggtaggagatggagtagataatcagatgtatgcactacaacagcagaagtaacttggggaagaaagaaaaccagctggagcaggaaggcagcttgtaggagggcttttgggaagggaaacaagaaagaacaagacataacagatatactggaaggtggcagcaagtaatggtttgaatgagaataaccccataggcgcatagatttaaatacttgatccctagttggcggaactgttaggaaaggataagaaggtgtggccttatttgagcaggtgtgtcactaggggcaggctgtctttctgcttcatagttatctcaatgtaagctctcagctactgtttcagctccatgtctgtctgactgctggcatgctccccactgtgatggttctgactctaatcctctggactctcacccaattaaatgctttctctccttaagttttcttgggcatggcatttttgttacagcaattaaaaaggtagctaagacacagagtgaaagaaatttctttgtgtgttaacctaaaaattaatttcaagaaaaataaacagaaataaaaagaacatttcttaagaatcatgtagatttataattggttttaatttataaaaataaaaaagaaatatgaactgtatggttgtgtccatgaacatttacaaacatgaaccatgaagtgagcacatgactacaaggcaagcaaaatgtagctgatgtgacatgagacgcgctggaaaatgtaagagctcttcttgtatttccttaatttcccttgagaacccataacaccttcccagagagtacctgatgcacacacaccaacaccaccaattgaccagatacttcatcctccttctgtgatcagtcagctcccagtctagaattccactttcttcccaaaagcaacttctctgttggtttttttcctggctctttttcctgtccttgccacttctctgtaagttttaccctatcctcagtttctggcctttaacatacagcaaaccctactatttttcttctcccacaaccacgcaaaatgccctctgtgtaggctgaggcctctcctgtatgttgcagtggtcaaagaacatctgaagatgatgaagacagcctttggtccctgcttcagctgttcctactgtttgcaagaaagccacctgctccatatccagtgagagaggcagctacttcctggtggtaggaccctaaaaaagcaactgaataaaccaaggagaattgggaaagagctatcagaggcagttggtgacattccttcctctatggcagaaatgctgggagcaatggcttaaggcaaagtgactcagaaagcctgtattgagcttccagagacaggcattggaaaagcagaaaaagagagaggaggaagacacatagaaagaaggaagccttatgaaaatcctctctagatggactagagaagtttggagtaaagatttttgagaggaaccctgttttgtgggcagcttggtcaccccagaccctccctgaagcacacactctgaaaaccagaggaagtgctgtgaatgagaattcctggggatggggatgggggtggggggagggcaggggtggagctgtgtctgcaaaggctgactgatggggtagaacttgaatgtcgtggagacaggagaattttctaggcccaaagcctacttacaatttatcttggaccatctttatcctattaaacagccatcctttgccccactctgtcagaccatagcacagaacctattgaaccttatatcctaacaaacacataaaaatcttttggaatattttaataaaaaacctgagtctcaatcaaaaggcttagagtgttgtctgatagcatctaagacctgtaatagagttctcccaatctggctataacctgcccacctgttatgtacccaccaatatgtttgaaaagtgcttgacttgtggattttttgttatgttttgtttctattaaaaaaattcatgaaactgctacctcattggaacatagtatttgaggagacctcaatctgtattctcaggctgtggccactcatacttgactccagaataagccatatcttttattccatggagctgagaactgtttctttcaccaacagtctcatagaactatacactgaaacttagcccacagaatacctctagatatcaggcagtaaactttgaatcatgaccatgcagtcttcagcaaggttgaaaactgatcagagccagaatctgcagtgtaccttggacacaaattccaaatgaacactgggcaccaggtctaggagcatgactagcatttccaatcagacctttaagtgacctctcatggataggttcagcctctgtgatccaacattacaaaggtctgcctagaggtgtgaccaagatccttaaatggaccagtgaaagaccacctaggaacaccaactgcatctgccacctgacctgtgaaagcctgccctggggtgtgcgacctcaatctgtgagcctagaaagggatgtccagtgaggaacagaatcagcagaacccaggggagagaccaagtacaggcgctataccctctccctcctttcctgaatgttcattccccccttccttggtacacaatggtgtcttaaccatcctattatacaattctgtttgtcttcttcctttctcattcccttcttcttttctcctgttctagtctttctaagttcccttttgaaaggttctccaaagaacaaaggctgccttggttttcaggtctctgtctcagtctctcctgagctggcactgttagggtgttgggttgtatttctttctctctttctcttctcagtctacatttagttggaactgcttccctctcatatccatccccattgctcattccttctatttagtttccctgtgtttctctaccatcccaataccaatcactagtcttattggacttttaaattttccatttatactttaagtgtctaatattatagagtatatagtaccattattgctatttggatacttcaattattggagttgaaggattgattttttttttaatcaactgctactgtatttttgtagtaggctaccctttagatataggtgtaaggatgtaatattagaatccaccctctggtcaggcctcctctcacagatactgacaagtgtcccctgggactctgtctctgggctctgagccggtacacttgatagacccacagtggctagccctggaagttagtttataccaagaggaccaacctctccatcctcaagaaggtatataaaaaacatactcctcactgctacccctgccatttgctctctgattctctttagagttcctgccatgggtctctctgtacccatgtcattggtactaggacctgacctttctttcaaggccctgacaagctgatgtccctttgtctgactgtatggtgctgataactcttcaaataaattccttaattcacactggttaagctcagcatcctcttgaaccacctgcccccacctaagacctaacacggggtctaggcgatggttttcagaactacatcccaaggctccaggagataatcccaagaactggcaagtgggaggacaggaaactgaagcttctgcacaacaacagaaacaatcacctgagtaggagacagccaaccaacagagagcaagagtccatgccaacaacacaaaagactggagatggatagccaggaggcataaaggagtgtagagaataaacaactgaagccaggaccacagtctcctggcccctgggatggaactgcctcacaatggtctttatgctcatccagtggctgctttccatgggaaactgccaatacaacccccacgccaggctataaaaccaagagaattggggtgagcatgtgggagccaagtgggagcttgaagtttgtagtcgttcctgccagttctgctctcagtatagaaaagacactgcccacaacctgtctgatgaaagagtctgtcaggacctggaggtgaaaacccactccttttgcccaggttcaaagtacaccactggtccacctaagactgcagtaaacagctatgggagatcatttctggacaatgttggtatttcttctcattgtgaagttccagtgtttgttctcaaaagcatacaaggctcattcaaatgccacatcagaagaaatattttacctataaagtaggtcatgggtgctgtgcagctcagctgagtcagaaacataactctagactagaattatgaaaaggcaggcacacaacagatattaattataactgtcttaattttatgtctttaaagatgttgagaaattgtggttgctcatttgttcttgacaggaggaaaagtgtttgccccacaagctgccaatcttccactttacattttgctagaaatgttgtataaggtatatacttgctctgaatcatttttaactatactttattttacaacttcatagtgaaggatgttaagaacattaatggtgctttgggcttaaataaaaagctgggtgtggatgggcacgcctttaagttcagcactatggaggcagaggcaggccagtctttgacagtctggactacatagtgagttccagattggccagagctaaataacaagactctgccttaaatgaaataaaatatgattttcaagcactcataaatagtttagagtcatttggcaatcaacatagatgtcaggccaatgtgcaatggaaatgcggtacatgagcacaacgaacaccataaagaaaaatggaattgtggaatttgcaggtaaaagggtggaactagaaaacatactgaggctacaaagacaaaagtcacatgttatctcccatatgtggttcctagctgtgaggagccgcccttacaattgccattacaagatggcgctgatatccggtgttctaactggtaaacaaatagtctgcgtatgtgctggggtatttttccattccttgtgccctgcctgtcccgtggcatcatctgggctgatagtgagcagccagtcagggtgaaatatgtctccaacccctcttgtggtctatgtaaggactgagtttcctgtgttctgggcctcctcccccagaagctaatcatctttctctcgagatggattaaagctatgctgcagaaggatctgagtgtgtcctgtgtgtgtgtgtccttgctggtgagacttatcatcacagacacatctggtgccaagatcccgggaacgccacaacatcgccggcattgaggaggtccctcggaaacagggaagatccagaactgcagtggaaggtaagttcggagagtcatagctgaccatgagacagcatgtcagaaaccaaatggagtgagagataaggagctcgtgagaaaaaagacatgtctaaggaaaaaggacttccctggaagttaaaagaaaaagggggagtgaaaaaggagaaaagaaaaaaacaaaagataatataaaatataaagatacaaaagataatataaattataaagatacaaaggataaaaattaaaattaagtcaatttaccctcctctcgaggactttgactaaagaggcagccttcattaaaggcttaaagatagctctcagggtcactgtacctcctctctcttctctggcagtattcccagaaggagataaagaagtggagtctgaacatgagagagagaaaataagttttagaaaagcagttatcccctgtttgagatcttttagcaaaaaagagaaaaaatgaaaataagctatttcagagcactcctggggaacagaataaaaatgggagacgtccttttttctctctgactcctatggagattttcttagctctggttaaaatatctgtgtccctttgagacaccaagttctattccctgtctgtctattgtctgtttttggtgcaccaaaacaaattgtccatatgtctgtcaattcatgtttatttttgttttgttgtttgaatgattactgttctgtgtttcatgttgaaaaatataaatggttaaaacttgttttaatagcagctttaatttacacagtacaagctgataagttagctacactgtggctgggagccaagtacagctgaataagccttgctgagagccgattacaaacggagctcttaaaggggcaggcagcctttcacttgtaacagaaagttagcttaaatttgggaattcaaggttagagtctttctaaacaacatgaacaaacacaagaaaacaagtctttaaggatacttcaacatagggataatctttgagccaagaccctggcagagtgttcagattgagaaaagtttgcatttgagttgaggcagagctcagagaggagcagcctcagcgcagcttgtgtggcacttcttagagccttattacagacctagccagatgttgttctaaataaaatttaaattcaaaagtttataaaaggtcaatcaggctataaaacttataaaggcatttcaaaataacttgcctacttcatataaaattattatagatttaaaagtttaattttttccatttgtaaagagtttacttctagtgaactggtgaccattaaaggtttttgcccctaggtatggctaacatagcttaacaatatgtaaaaaatttttattatcagcttcaatactagaagcaaaaggtttaaatatttcagtatatattgtttcctaagtgaaaagtattttattagctaatgtctctaaagggaagtttaaagttctggagaatagttgttgcttcataagattaagaggcaatatcttttttaataattagggtttcagttatactggaaaattggtacaaatttacttcaaaattttatttccaaaagcttacgggatatgttaattggctaagacctcaccttaaactcgccacaggagaacctaagcctttgttaggtgctatcaagtgagattccaattaactggtgagaaccaaaaaggctttaacagagagtagaagaaacttctgtaatctattggtatcaattgtaattggtggtaatcaaatattagttacatattctagttatttttattaaatgtgtccacagctattttttggcaaaaataaacattaatgtaaaatcatccttcttctcctcaaagttttaacatcctattataaggctgctgtggtgctaattaaaaattaagaattccttgttccaaacagcaattggttattgcagattattgatatttgacctattatataccatcattttaaataaaattgatactcatcctaagataagttaaaaattgcatatgcatgcttttgtatcttcatgcatgcttatatcccatttactgtatttaaaaacaacccttctatgggagaaaagtatatgtaaattaaatcacatgcttatcctgtttcagcacagataattaaattgtgtgctgaagatggtgtttaaaaatgttgaaaaattaaactttaagttgtatattaatagtcaatattatatctcatagcttgcaattgcttatgcaacttataaggaaaaaatactgtttctttaagaaaattgtttttgggcagttaagaacttgtcctggattgcctggaaaagacccccaggatttgcttttgtgttatagaggtttacataaagctttaactaataaagattacagatagctcctgaaaagatacaaactcaggattcttatatttatttgggttttaaaagatagttatttacagagacaacttaaagactttctctaatttctgattaataaataaattatatacaagtgactataatgacttttcaagcattctagttacaatctctcttcaagagaaacaattgaaagtgtaattagtcactgttcatgttatattaaaactgactaacagttcagtatctaaaattttgatgaaaatacaagattgtattttgatgcgtgagcaccccttttatattcaacatattagagcacatgcatcattacctggctcctattcaagaaaaaaatccctaaactgaagttagccactgacaagaaagactaaacagataagtcctagctgtttattttgtaaatctaaatagtatatatgactgggctgaatagccaccctagaaacaaatgttctgttcttgttagtcaaaaacattcatgacagttttgccatcagataattgtgactcatctgactggccttccttataatcctcaaggacaaggcattgtagaatgtgcccatcgcactctcaagtcctatttaattaaacaaaaaagggggataaaggctatgatgccaaagatggctctatcccttataacatttactcttaatttcttaaaattggataatgctgggagatcaccagctgaaaggcacagacaatggcctcaatcactcaatgaaatggtcaagtggaagaatgtccttgataataaatgatatggcccggatcctattttaataagatccaggggagctatatgtttttccacaggaggaagataatcccttttggattctggagcgcctcactcgaaggatccagctcttggacaatgagtcacaggaacaagatcccaagacatcgatggatcatacttctcatgctggagattctggttcctagtatatctggagagttaagatggggaattatgtcaaccttccctcttcctatggcagttatgcataatgcacaaatatttccacgctttttcactacagataagaactgggacttgcttatttacccttagatgaacagattcaggctttactagaaaatagaaccttcttcttacagggaagcctgtgctttatgttaatttcctcattacaagataagagccaatgtatatccttgcattatcaatcagcagcctggttaagaaagagctcttggggtgtaacaactgatataaaggctgataccatagttattagaggatggtggcctagtcgaaaacctggaaataagctgccttcacaaccaagaatggcacccttttgcaaggaagggtccatggaagatgtaatgttaccttggacaggttgccaagctaaaaaatatacttgggcagtagacaaatatttttccttttccccatatattagtagagagtataatgatacttttgctggatatgattttagtactatggaccccctccgaactaatactaacccatttgatcagtggttgctttgtggggttaatggaagctgtactgatctcgcccccatggcaatgattggaggaggttctagtgagaaaggagaattgacctttgattggaaaagtaccttgaagaccggctggtctgataagcagagtccaaattcttttaaatggaccatctccaatgtaagatataaaaaacagaaagaggtaaattttactgccaccccggtatgtgtatggcccccgtttttgtgggtggtaagtaacacaagtttaaatcagaatcagatagagatagattgctcacaagaaaaatgtttttatgccttatgctgggatgctaagaaatatccttttgctttggttacccgcatgcctagatttgttcctgttcctgtagatgcccctaatagcttgactttgtttcgagggaaaagagattttggtatttctgctatcatagttggactggtggccacagcggtggttgcagcctctatcacgaccttggcactcgctctatctactactgttcaaacaatacaaattattagccagctttctatgacagtcacaacggccttagataaacagcccacagccaactcacagatacaaggagggttgatgttgataaatcaatgcatcgacctagtccaagagcaagaggatattctttggcagttggctcaattgggctgtgaatacaagatgcctggcttttgtgctacttctgttcagtttaaaaattctacaagcaaacgcttcgagagttgagagttgctattctacaagtgaattctacgcatctcgaccttttgctgacgaagggcttctccacctggatttcctctgcattttcctactttaaggagtgggtgggggtaggcttgtttgccgtgattctatgcggtggagcgttgcttttgctctagatggtctgtaaacttaaagcccaaacaaaaagggacaagatggtgatagcccaagcacttgcagcattagaacacagtacctcccctgatatatggttatctatacttaagcaataggttgctggccgctcagctcttgtaccccacaaggctagtctcattgcatgggatagagttgagtgtgcttcagcagcccgagagagttgcacggctaagcactgcaatagaaaggctctgtggcataaaatgagcctattctagggagacatgtcatcttgtatgaaggttgagtgtccaagtgtccttccccctggaaaaacgacacgggagcggaccaagacccctccgggtgacgagcctgggagaaggatttgtgtaatgcccctatttttgcacactggggatttgacctctatctccactctcagtactgggtggcctgttgccttttaaataaaagaaaagggggggggaggatgtgaggagccgcccttacaatcgccattacaagatggcactgatatccggtgttctaactggtaaacaaatagtctgcgtatgtgctggggtatttttccattccttgtgccctgcctgtcccgtggcatcatctgggctgatagtgagcagtcagtcagggtgaaatacgtctccaacccctcttgtgatctatgtaaggaccgagtttcctgtgttctgggcctcctcccccagaagctaatcatctttctctcgagatggattaaagctatgctgcagaaggatctgagtgtgtcctgtgtgtgtgtgtccttgctggtgagacttatcatcacagacacacctagctccaaatcttcagatgtcaggagta

SEQ ID NO: 66 - DNA, 31 bp, Artificial Sequence
  ugt23275F primer
gaagtcgacgtttcagagtcataccaaaagg

SEQ ID NO: 67 - DNA, 30 bp, Artificial Sequence
  ugt27501R primer
gaagtcgacatcttacacaggtcccaaagc

SEQ ID NO: 68 - DNA, 21 bp, Artificial Sequence
  ugt35967R primer
ctaagaatgagcaaagtgtcc

SEQ ID NO: 69 - DNA, 23 bp, Artificial Sequence
  ugt31170F primer
gcaatactagctagaaaggccag

SEQ ID NO: 70 - DNA, 4643 bp, Homo sapiens
cctactctattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagcgcttcgctctctttgccacaggaagcctgagctcattcgagtagcggctcttccaagctcaaagaagcagaggccgctgttcgtttcctttaggtctttccactaaagtcggagtatcttcttccaagatttcacgtcttggtggccgttccaaggagcgcgaggtcgggatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggtgctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtg

SEQ ID NO: 71 - DNA, 22 bp, Artificial Sequence
  MDR1 primer
gaaaccctaggcactaaatccc

SEQ ID NO: 72 - DNA, 10094 bp, Homo sapiens
gacagacatttctttattttggttgaattattctgtacttattaggtatttgtctattttatttatctattcaggtcacttttaatttcaatagttaaaaatccattaattttactgtttagctgaattaattgcattctcctacttttatgtttcatatttttgtgcttcatttgtttcaatcttttatttttcttgttaaaaggaatccattattattcacattatcattgacaactgtgagaatctgcagaaaaaaacaatatggaactacaacttcacgttcttgagaaaagcttgcagtgtaagatgcgtttgtttgtggtgcctgaggaagagaggttggtgaaattgcacttggactcagtgaatcggaaatagttttaactctccagtggaacacactgtgaagttgtcaagtcccttgatttctcaacgataccaactagttcaataagcaaagagagtatgcttgtgcctacttgttgcccaatgaaagaatcaaataatttcactgattccagcagcagaaaaagagagttggtagtgctgagctgctgaaggttcattactgcttagccttgagaatggaggccccacttggtactcttcataagagatgccccaactcgtcaaaggaattatggtaatctccttactttctgttgcacattcttccctctgctaatctcagtacactcatactaactttcttgtctgttaagtgatctcacatgttttgaaaccaagttcagataaactcacaagtgggttaaggggccagaatagtttaaaagaaatacaattacttcattatctcacttacatgtgaactttaaaatgttgaccttataaaagtagagaccagaatagtggttaccagaggctggggggtaggggcatgggaggtgttgatcaaaggtacaaaatttcagttagggaagaggaataagattttgagatctactgtacagaatggtgacaatagttaataataatatattgtatatttcaaaattactgaaaaagtagattttaaatgtcctcactacaaaaaatgataagtataagaggtgatagatatgttacttagcttgatataatcattaaatgatgaatatatatcaaaacatcaagtacaattactaatcaagtaatttaaaaaaaaaattaaaggaaagacaggcagaaggaattattattgctgtgttgatgaaacagaatgaacaaaagataaattttgtttccggaatttaaaaatgagagtttcttaatttaaaaaatgtgataatgtaagacaagacttggaaaggcaaataaaggtaacattttacagaaataataaaaaatgcaacgctataaaataactaataatatcccatgaaatacacagaaaatattccaaaagttcaagcagaactcaaagaaacagatgagatcagagagagagagagacagagacagagagagagagagagagaaagagaatgttagaataggagcataacagtgagaaataagatctaattattcatgttatatttaactgcttgctcaatcttagaaagtgcaataaaaaatttcagaaatgctaacctaaattctgcaaaaatcttcctaactagactttaatatttgtttaaaagtgtgtttgttttgagcttgaaggtatatagtccaaatgtagtcctcatgctttagctgggttagttcattagccatttcagggtgatcatattatttatttgaatttagtttggttcatctatttctgtttgaattttatttatggtacctttgccataattattgattatttttgttctctcacactctctcatacgtgaaatatttacatggttccaattatcagaagcataccataatgtatattcagagaactgacatgttacccccttcattctattattttcactatgttcccatccacctctgctttctggcttagtattcccacttttgattttagaggagccaccagaatgttttattatctcctcccatttttaaacacaacatagagtatagtttttttatacttttattttacctaaaaatagcctgctacatattataattatatatacaattataatataatcatactctattaacttaaaattttctttttttacagttacatagtactctgtgtctgcatacatttctgatttagtcaatctcctttgttttgacatttagctaattttaactataatattttaaattatacatttaattggacatttagctaattttaaactataatattttaaatagttaaaatagctaattttaactatttaaaatattatagttaaaaattagctaaatgtccaaacacgagggctcacgcctgtaatcccagcactttgggaggccaaggcaggtggatcatgaggttaggagatcgagaccatcctgactgacatggtgaaaccctgtctctactaaaaatacaaaaaattagcagggcgtggtggcacgcgtctgtagtcccagctactcaggaggctgagtcaggagaatcatttgaacccaggaggtggaggctgcagtgagccagagctcaccactgcactctggcctgggtgacagagtgagactctgtctaaaaaaaagaaaagaaaaaaaaaaagaaaattataattattgcatacacacacacacacacacacacacacacacacatatatcctatcttctgcttaaatttgtgatatcctatcttttgcttagatttgtggaagtgaaattgcttagccgtaagttactatgtagattttttggataaaaccaaaaatccttctttaggaatgtgcatttcctcagaagttcatgggagtgcattttccacatatcctcaccaaagagtgctgtaactcctccatcagcctgtctgtctctctctctcatctttctatctaaacttggctaaaatgacataaaagaaataatatctcagtttatattgataattcccttataataagaaaagttaaataaatgttcatatgtctaagagcttttgacatattcttgtgagttgtcagtttacatctctgcccttatgtttctatcaaatttttagtcttttcctcccaatttgtattaattaaaaaagtcttttattgttaaaataatgttgcaaatattttctcccagtttttcaattgtattttgatgtttctatatggtgtttttgctttgcaaagtttttctttctcttttttttttttttttggatgtagtcaaatgttccactaatttttttcattacctctgaaattttattcagacttagaagaattttacctacatagggttatatagaaattcatctctgttttatctcatcctgaaatgttttgatttctttaaaaaagtaaatactacatttattttaattattattttatataatgtgagaagggatttaattatgtctttttcaaaatggcaaactgattgattgattgatcccagagctatgcattacaaatctcctcatcacctcagtgttttaagattctacctttatcataaactaaagtttattttttacttgcatttatttctattatataactacttctttatcctatttcactgtatgtctgcatgcaccaatgcacagttttaattgtaaggtttttatatagtatgtttagtatcgggtaaagctaatttcttcccctatactacagctttctttttagtatttccaagttaattttgtatatttacttgtgtatttttgtacattttgtatacttttatatgtttatatttcttttgtatattttttatatttattttgtatgtttatttttacatgtaatttcagtatcaacttgtctaattatgtaaagaaacttattaacatagagattgcagccaaattataaattaacttatagggagctaagctgtattctataaagtttaagcacctcacacaaaagtaaaagacttcttcccattttaataattttaattttatatttttcaggccttttaaatttttttcatgtagattttacacatttcttcttacacttatctcttagtattttatagttattgttgaatattgattttatgtgttattatgttacctgtgtaactatgttacctgtgttacctgtgttatgttacctgtgtaactatgttacatgtgttacttgtgtatatgtattagatatgctattttaatgtttactgtactgttgaattgttttattttaatttagttttattactgaatctctacggttttctagttacaaaaccttatcatctacaaatataaatagctttcctttttgtttctgattcttatgtctctaaatgattcattttgtctaactgaattggctaacctctactattaagttgaacattagtaagaagagtgcaatacattctttaaaatcttattggaaatacaagtagtgtttctgaattaagtaaaatactgattctaggactaagattatataaaattcccatatcatgttaagaaagtaaacatcaattaacaattttgtactttttttcatctctcaggaataaatcatacattttgtaaaggactttccatcttctgtagaggaaaaatagctggtttttacttttagatgtatgaatatggtgtgcagaaagagttaacatatagcagacctgatttctatccttcgaaaggcctgattaaaagattaggcttggctgatgctgagaacttagattttggaaggattaccatcactctgatgggtaagaatggctcactgtgcctaaactgcttgtacaaaaaatgtagtttatgctaacctttttctttccttctaggagtctggaattttgataggtgctaggcagaaggtgcctcctgactatcccctaatagaaaccctaggcactaaatccctaatgagcttccctggtggacagcatttcatgtatgttgtccaaagttgttgctgagggaattaagcacagcccatatgattccacagggaaaggactcctagaaactttcatacttgtttttcactggacattgccgcatatgccttttccctttacttatatgctttgcatccttttactgtaatatatgatagccatgaataagactatgagtcctcctagcaaatcatcaaaccagaagattcatatggtttttatatcaatgaatttcctaatattgtatcaatatcatattcccagaataaatcacacttgatcaaaatgtatcagtttcttaatgatgtgttatattgttactaatatttttacatttcaatcaatattaataactgatatttgtctataattttcttttctaactgtattaggtttaggtataaatgtcatacttactttacaaaaagtattagattttccttaattttttgaaattttcttttttataaggtgcaaaaattttcaaaatcattgggactatccaggctttgaaattttgatacaagtcttccttgaaatcatctgggcttaatgattgattttgaggaagtgtcttgataaatttttcttttcctgatagagaaattagcttatttaaattttttacatatagtagggcctatttgggcaaattatatttctgtaggaaattatcattatatctttcaaatatataacagagagattgtaggattttttaaatgcatcatatgtcatgtcaatggttacttcctccttgtccttttattatacatatacctcagttaaggtagctagtaattggtctctcttgaaaattttttaccaaaaaatattatttttatttagtaattatgtgtttctcaatttagataaattgataaagcaaatattgtttattttttgctttattgttcctttattttttctgtttgtttttcttatcttgtttaacatgaaaatttcattcatttataatttgtatttttattaataaaagggtttagggctataaaactttttctggctacattcttgaatgtattacaggtgtcctgatatagaatacctccattatccatgatttttattaaaaaacacttttggattgtattttacctttaacccaagagtttaatttaaaaagggaaagaaaaatgatagaagtaggccaggcacagtggctcacacctggaattccagcactttggaagctgaggcaagaggatacttgagcacaggagttacaaactgccctgggcaacatagtgagactctgtttccacaaaccagttttaaaagttagccaactaatttggaaagatggcttgagcctgagaggtcaaggctatagtgagccatgactgtgccactgcactgcagcctagaagacagagtgagaccctatcttaaaaaatcatagaagtaataatatcataattatacacaattaaactacattgcaaataccaaaaattttacttgttttaaatttctacactaatcatgtacagctgtaacagttgtacagtaaacagctgtatatagccttcacttctcactagacatcttatcaaaaaagaacttaaaatttatgggaaaaccttgcactttgtgttagaaacttagtttcttggctttcttattcctatctgatggagggcaaagaacttcactagtttgcaggctacgcagagacaaattagaaaagaaacataaaacagaaatattttgtgtatagcacattgcccaaagatgagataaattggtctaaaaatgatatggtgcaatggagacatttaagagcttgttagcaattcctacaggtcccaagaggttcaaacagttcagaaacagaacagaacatgattcagtatattttcagagaattcaaaagtttttgtaaagctcactcaggaaatcttcagggaaaaacaaactttgctcctctttttatttggtaactttctatattctcagaataagcttgaaaaccattttacgttggctccaatatcccacaaatctggcaacagtgacaggagtcatgtcattctgacagttggacctgactaaactaagttagtggccaccagtgtctgtcaattttaatgatggtaggcagatttcccaaagtggtaatcactctgaacgtggtttattttttatttttttaaaaattaattaattaatcaattaatttttgcctgtttttggcacttctagcaagtattctcttagtattctttgtattcctactcttcctctttgcaaattgcctatatgcaatcatcaagtattttaatgataattcctgtctttatttccgttactctattctctccttgtcagtgactttccttccaatatcacgcacttactccatacagaccgtttcaaaacttttccattctccattccctccagcttcccttcagtaattggtcagttaataagcctttctgatcaagtcaccatctctcactggaattgttgcaatagtctcttgactggcctttctgatttttgcccttgccctctacagtttattcctaacaagacaactagtgtgacaaagcaatcaatcaatcagtcaatattgtccttcctatgatgaaatgcttctattccaatggcttctgttgtctctaagagttaaagagaaattattaaaatagctattaatgcccacattctagtcctttaatatattatattaatatattatatattaaatgttatatatataattaattatatataatataattatatgtattatttatatattaatataaattaatataatataattatatattatattaatataattatatattaaatatattatattaaatattaaatatattatattatattgattatataattattataaattaattatatataattattataaattaattatatataattattataaattaattatatataattattataaattaattatatataattattataaattaattatatataatataattatatatataaagtccttatatattaaatattatatatttataatattatatatataatatttatatttccctcatcctttatagcatttcacactacctgtggcttcactggagttattgcattgaatttgctgccttttacttaagtcaaactttttgctcacagtgaaaggaatagagaaagatgtagggagaccccctgaaactattgctacagaataaaagatgaaatgctcctaattattgtaaatacaaaattgcatgcagtattgtgtaaagacaatgccaggttggactgccagaatgagccaacagcgcgtgacgtgcttccccctgcagagagcctatgaatggacgtgcggtcagggaggtttcacatcaccaagattcctatcccagaaaagcagatgttcatagctctaggaatggaatgcgacccttgtggagagcctataaacggatgcatggggcgggggggtgcctgtccatatggataagatagggctataaacgtcctcatcttgccatggctcttctacacctctttagggttaaggcatactcctttctgagaatttctcgtctaaccagttgtctatcttcacgtcctatttccatggattgtttgtaaccagcttttgttgcaactgttactgctgattaatatcttgctaatcataggttatggaaagattgtgtttctgttttaaggctctgttagaaattactaacacacacactatattgtaaattcttatctctgtatactgtacttctccatacaaatgtactgtacttctatatacaaatgttatgttaaagaattacttcatccccatgtgaccatctcacctcataatcaaatgaccctaaatccctcactaacctacccctgccctcactaaacttaataataaatgctggtatatccagtgcattgttggcaccgtgggaccagaaggtagtgacccccctggacccagctttcactatcttgtgtgtgtctattatttctcaacctgccgatccgcctaagaacaaagagagagccccgttgcattgcaggctgctggccagatcccacaatacatacacagattccaaaatgcattcttaactcttaaaagattttggttacttatcactattctgtctacttttctgtaattgagaaaagtatttgtcaactcattttttctctctgtgacagctcagtcatttacaaagttttattttatactttactccttccttcaatttgtgctaaaacattgtgaaaattaacatttctttggaacacaactttttcattataaattaaatactgatataattgcaaagtaaacaaatgaatttccataaagctaatttatctttatattttccatacttattacttcaaattcttgttacattttcaattttgtttgaaatatcatatggtattttaaattgaaatttactaattattttttagccagtggataaagagaaattaaaaatttgaacaaattaattcaatttttacttcacttctcatttgaaggtcttcccagtaacctaccaaaagaagtctctctcttttttttttttttttttagcttagattctaatcttcattctgcctattctggctaaacttctcaactctggctatttttcaattataccccaatccctaagccatgtaactcttcgaggtttttgtttgttttttcaactgctcattaagacgtcctacaccttagcaaaaagatcacacatatttcttcaatgctttggagccatagtcatgtactcaaaatttattttatctctactcccacccttcctccacccaaacttatccttgggttttcactgattagtgctttcaagcctgcctgccttagttcatgtagctcctcctctggtactgggataaacacttgtattaccattttaaaggctatcattactctttacctgtgaagagtagaacatgaagaaatctactttattcagatattctccagattcctaaagattagagatcatttctcattctcctaggagtactcacttcaggaagcaaccagataaaag

SEQ ID NO: 73 - DNA, 22 bp, Artificial Sequence
  MDR2 primer
gggatttagtgcctagggtttc

SEQ ID NO: 74 - DNA, 23 bp, Artificial Sequence
  MDR3 primer
ctcattctcctaggagtactcac

SEQ ID NO: 75 - DNA, 23 bp, Artificial Sequence
  MDR4 primer
gtgagtactcctaggagaatgag

SEQ ID NO: 76 - DNA, 22 bp, Artificial Sequence
  MDR5 primer
aaagcttgcagtgtaagatgcg

SEQ ID NO: 77 - DNA, 28 bp, Artificial Sequence
  MDR6 primer
cacatgaaagtttagttttattatagac

SEQ ID NO: 78 - DNA, 26 bp, Artificial Sequence
  MDR7 primer
tggtcaacagagcaagactccgcttc

SEQ ID NO: 79 - DNA, 1940 bp, Homo sapiens
ggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgtgacattccttattagttgaattggtcattgatataaacttctttgttatttgataatgtaagtaaaaaatgtaaatgtatatccttcaagacagcaattgtaattataaggatttaagagatatgtaaaaggatacttttagtagcattacttataatattgaaaattggaaagatctaaatatttaacagtaagaaattatacattaagttttggtgcattcacaaaatggaataccatataatcattagaaaattatgttgaagaatattacaaaatataatttgtataaagaaaaaatggttgccaaatggcttgaacaatatggtggctttttaaatattatatatataatataaatctatatttatgtatctatagttatctatctatatttatgtatctgtaactatagatacagtctatatataattatatataattttatatatatataattatatataattttatatatatataattatatataattttatatatataattatatatataatatatataattatataatataaaattatatataattatatatataatatatattatatatataatatatataatatatataattatatatactatatatatatttaaacttctgagagacaatccaaaataaaccagaattagaaacaattttatctcctaagttttcagcttttgttttaaaattttaaggctttaaaaagtgtgcttagtttaggaaatttcgataaatttatgtgaatagaagcataaaaccatgtcacttggtttgacttcttaaagatttttccctcaactctttgtatgtctgctgtaaggacactttctttttttttttttttctgaagcggagtcttgctctgttgaccaggctagactagagt

SEQ ID NO: 80 - DNA, 29 bp, Artificial Sequence
  MDR8 primer
gcgccagtgaactctgactgtatgagatg

The invention claimed is:

1. A transgenic mouse comprising in its genome a disruption of an endogenous mouse alpha-acid glycoprotein (AGP) gene and a nucleotide sequence that encodes a human AGP operably linked to a promoter, wherein the expression of the endogenous AGP gene is abrogated or reduced, and wherein expression of the nucleotide sequence that encodes the human AGP provides a mouse that predicts behavior of a drug in a human.

2. The transgenic mouse of claim 1, wherein the human AGP is selected from the group consisting of: AGP-1, AGP-2 and AGP-3.

3. A method of predicting a behavior of a drug in a human, as part of a drug screening or evaluation process, comprising
administering the drug to a transgenic mouse according to claim 1, and
conducting analytical tests to determine the behavior of the drug in the transgenic mouse, the results of which have a higher correlation to the behavior of the drug in a human than the results obtained from a wild type.

4. The method of claim 3, wherein the analytical test comprises assessing directly or indirectly, a concentration and/or distribution of the drug in the transgenic mouse to which it has been administered.

5. The method of claim 3, wherein the analytical test comprises assessing directly or indirectly, an efficacy of the drug in the transgenic mouse to which it has been administered.

6. The method of claim 3, wherein the analytical test comprises assessing directly or indirectly, a toxicity of the drug in the transgenic mouse to which it has been administered.

7. The method of claim 3, wherein the analytical test comprises assessing directly or indirectly, a half-life of the drug in the transgenic mouse to which it has been administered.

8. The method of claim 3, wherein the analytical test comprises assessing directly or indirectly, a pharmacodynamics of the drug in the transgenic mouse to which it has been administered.

9. The method of claim 3, wherein the analytical test comprises assessing directly or indirectly, a pharmacokinetics of the drug in the transgenic mouse to which it has been administered.

10. The method of claim 3, wherein the analytical test is at least part of a drug-screening process.

11. The method of claim 3, wherein the analytical test is at least part of a preclinical assessment of a drug.

12. The method of claim 3, wherein the analytical test is at least part of a drug-selection process.

13. The transgenic mouse of claim 1, wherein the genome of the transgenic mouse comprises replacement of at least a portion of the endogenous mouse AGP gene with the nucleotide sequence that encodes the human AGP.

14. The transgenic mouse of claim 1, wherein the genome of the transgenic mouse comprises a disruption in the endogenous mouse AGP gene and insertion into the genome of the nucleotide sequence encoding the human AGP.

15. The transgenic mouse of claim 1, wherein the genome of the transgenic mouse comprises a disruption in the endogenous mouse AGP gene, wherein the disruption results in reduced expression levels of the endogenous mouse AGP gene.

16. The transgenic mouse of claim 1, wherein the genome of the transgenic mouse comprises a disruption in the endogenous mouse AGP gene, wherein the disruption results in abrogated expression levels of the endogenous mouse AGP gene.

17. The transgenic mouse of claim 1, wherein the genome of the transgenic mouse comprises a disruption in the endogenous mouse AGP gene, wherein the mouse lacks the ability to produce a functional mouse AGP.

18. The transgenic mouse of claim 1, wherein the genome of the transgenic mouse comprises a disruption in the endogenous mouse AGP gene, wherein the disruption comprises a deletion of at least a portion of the endogenous mouse AGP gene.

19. The transgenic mouse of claim 1, wherein the genome of the transgenic mouse comprises a disruption in the endogenous mouse AGP gene, wherein the disruption comprises a deletion of nucleotide sequences encoding a region or domain of an endogenous mouse AGP.

20. The transgenic mouse of claim 1, wherein the genome of the transgenic mouse comprises a disruption in the endogenous mouse AGP gene, wherein the disruption comprises a deletion of a regulatory polynucleotide that controls at least in part the expression of the endogenous mouse AGP gene.

21. The transgenic mouse of claim 1, wherein the genome of the transgenic mouse comprises a disruption in the endogenous mouse AGP gene, wherein the disruption comprises a deletion of the entire open reading frame of the endogenous mouse AGP gene.

22. The transgenic mouse of claim 1, wherein the promoter is endogenous to the mouse or in a human.

23. The transgenic mouse of claim 1, wherein the promoter is an endogenous mouse AGP promoter.

24. The transgenic mouse of claim 1, wherein the promoter is a human AGP promoter.

25. The transgenic mouse of claim 1, wherein the promoter is obtained from an animal or source other than the mouse or human.

26. The transgenic mouse of claim 1, wherein the promoter is an inducible promoter.

27. The transgenic mouse of claim 1, wherein the disruption has been introduced by homologous recombination or introduction of a recombinase system into the genome of the mouse.

28. The transgenic mouse of claim 27, wherein the recombinase system is a Cre-loxP or FLP-FRT system.

29. The transgenic mouse of claim 1, wherein the transgenic mouse is heterozygous for a transgene that comprises the nucleotide sequence encoding the human AGP.

30. The transgenic mouse of claim 1, wherein the transgenic mouse is homozygous for a transgene that comprises the nucleotide sequence encoding the human AGP.

* * * * *

UNITED STATES PATENT AND TRADEMARK OFFICE
CERTIFICATE OF CORRECTION

PATENT NO.        : 7,544,854 B2
APPLICATION NO.   : 10/475069
DATED             : June 9, 2009
INVENTOR(S)       : John Michael Daly It is certified that error appears in the above-identified patent and that said Letters Patent is hereby corrected as shown below:

At column 8, line 53, after "been" please add -- administered. The invention also encompasses the use of the transgenic animals as broadly described above in the study of drug metabolism and/or behaviour. --.

At column 15, line 16, please delete "tblastn" and insert therefore -- blastn --.

At column 18, line 3, please delete "naturally-occurning" and insert therefore -- naturally-occurring --.

At column 21, line 38, please delete "naturally-occurning" and insert therefore -- naturally-occurring --.

At column 27, line 48, please delete "phosphoransferase" and insert therefore -- phosphotransferase --.

At column 27, line 61, please delete "gancyclovir" and insert therefore -- ganciclovir --.

At column 27, line 62, please delete "gancyclovir" and insert therefore -- ganciclovir --.

At column 28, line 41, please delete "transgcene" and insert therefore -- transgene --.

At column 29, line 41, please delete "pronucleal" and insert therefore -- pronuclear --.

At column 31, line 11, please delete "mammnals" and insert therefore -- mammals --.

At column 31, line 36, please delete "trangenic" and insert therefore -- transgenic --.

Signed and Sealed this

Eighteenth Day of May, 2010

David J. Kappos
*Director of the United States Patent and Trademark Office*

CERTIFICATE OF CORRECTION (continued)
U.S. Pat. No. 7,544,854 B2

At column 31, line 62, please delete "intrathecially" and insert therefore -- intrathecally --.

At column 33, line 63, please delete "CDNA" and insert therefore -- cDNA --.

At column 35, line 53, please delete "polyadenyation" and insert therefore -- polyadenylation --.

At column 36, line 65, please delete "infimdibulum" and insert therefore -- infundibulum --.

At column 41, line 58, please delete "ie." and insert therefore -- i.e. --.

At column 49, line 11, please delete "MR-1" and insert therefore -- MDR-1 --.

At column 49, line 42, after "[SEQ ID NO: 70]" insert -- . --.

At column 50, line 22, after "MDR6" please insert -- . --.

At column 51, line 32, after "800μL" please insert -- . --.

At column 51, line 54, after "plates" please insert -- . --.

At column 52, line 19, please delete "pickling" and insert therefore -- picking --.

At column 53, line 50, after "type" please insert -- mouse --.